(12) United States Patent
Brandt et al.

(10) Patent No.: US 11,952,408 B2
(45) Date of Patent: Apr. 9, 2024

(54) HPV-SPECIFIC BINDING MOLECULES

(71) Applicants: Juno Therapeutics, Inc., Seattle, WA (US); Editas Medicine, Inc., Cambridge, MA (US)

(72) Inventors: Cameron Brandt, Seattle, WA (US); Brian Belmont, Brookline, MA (US); Christopher Borges, Cambridge, MA (US); Stephen Michael Burleigh, Seattle, WA (US); Alexandra Croft, Seattle, WA (US); Stephen Jacob Goldfless, Seattle, WA (US); David Jeffrey Huss, Seattle, WA (US); Yue Jiang, Seattle, WA (US); Timothy G. Johnstone, Seattle, WA (US); David Koppstein, Seattle, WA (US); Hieu Nguyen, Seattle, WA (US); Christopher Heath Nye, Seattle, WA (US); Haley Peper, Seattle, WA (US); Blythe D. Sather, Seattle, WA (US); Sonia Timberlake, Seattle, WA (US); Dean Y. Toy, Seattle, WA (US); Queenie Vong, Seattle, WA (US); Gordon Grant Welstead, Cambridge, MA (US); James Sissons, Seattle, WA (US)

(73) Assignees: Juno Therapeutics, Inc., Seattle, WA (US); Editas Medicine, Inc., Cambridge, MA (US)

( * ) Notice: Subject to any disclaimer, the term of this patent is extended or adjusted under 35 U.S.C. 154(b) by 527 days.

(21) Appl. No.: 16/652,379

(22) PCT Filed: Sep. 28, 2018

(86) PCT No.: PCT/US2018/053650
§ 371 (c)(1),
(2) Date: Mar. 30, 2020

(87) PCT Pub. No.: WO2019/070541
PCT Pub. Date: Apr. 11, 2019

(65) Prior Publication Data
US 2021/0284709 A1    Sep. 16, 2021

Related U.S. Application Data

(60) Provisional application No. 62/653,529, filed on Apr. 5, 2018, provisional application No. 62/597,411, filed on Dec. 11, 2017, provisional application No. 62/567,750, filed on Oct. 3, 2017.

(51) Int. Cl.
| | |
|---|---|
| *C07K 14/705* | (2006.01) |
| *A61K 35/17* | (2015.01) |
| *A61P 31/20* | (2006.01) |
| *A61P 35/00* | (2006.01) |
| *C07K 14/725* | (2006.01) |
| *C12N 9/22* | (2006.01) |
| *C12N 15/11* | (2006.01) |
| *C12N 15/90* | (2006.01) |

(52) U.S. Cl.
CPC .......... *C07K 14/7051* (2013.01); *A61K 35/17* (2013.01); *A61P 31/20* (2018.01); *A61P 35/00* (2018.01); *C12N 9/22* (2013.01); *C12N 15/11* (2013.01); *C12N 15/907* (2013.01); *C12N 2310/20* (2017.05); *C12N 2800/80* (2013.01)

(58) Field of Classification Search
CPC ...... C07K 14/7051; A61P 31/20; A61P 35/00; A61K 35/17; C12N 9/22; C12N 15/11; C12N 15/907; C12N 2310/20; C12N 2800/80
See application file for complete search history.

(56) References Cited

U.S. PATENT DOCUMENTS

| | | |
|---|---|---|
| 4,235,871 A | 11/1980 | Papahadjopoulos et al. |
| 4,452,773 A | 6/1984 | Molday et al. |
| 4,501,728 A | 2/1985 | Geho et al. |
| 4,690,915 A | 9/1987 | Rosenberg et al. |
| 4,777,239 A | 10/1988 | Schoolnik et al. |
| 4,795,698 A | 1/1989 | Owen et al. |
| 4,837,028 A | 6/1989 | Allen et al. |
| 5,019,369 A | 5/1991 | Presant et al. |
| 5,087,616 A | 2/1992 | Myers et al. |

(Continued)

FOREIGN PATENT DOCUMENTS

| | | |
|---|---|---|
| AU | 2004/308964 | 7/2005 |
| CA | 2551560 | 7/2005 |

(Continued)

OTHER PUBLICATIONS

US 8,252,592 B2, 08/2012, Sadelain et al. (withdrawn)

(Continued)

*Primary Examiner* — Catherine S Hibbert
(74) *Attorney, Agent, or Firm* — MORRISON & FOERSTER LLP

(57) ABSTRACT

Provided are binding molecules, such as TCRs or antigen binding fragments thereof and antibodies and antigen-binding fragments thereof, such as those that recognize or bind human papilloma virus (HPV) 16, including HPV 16 E6 and HPV 16 E7. Also provided are engineered cells containing such binding molecules, compositions containing the binding molecules or engineered cells, and methods of treatment, such as administration of the binding molecules, engineered cells, or compositions.

46 Claims, 91 Drawing Sheets
Specification includes a Sequence Listing.

(56) References Cited

U.S. PATENT DOCUMENTS

| | | |
|---|---|---|
| 5,200,084 A | 4/1993 | Liberti et al. |
| 5,219,740 A | 6/1993 | Miller et al. |
| 5,283,173 A | 2/1994 | Fields et al. |
| 5,468,614 A | 11/1995 | Fields et al. |
| 5,789,538 A | 8/1998 | Rebar et al. |
| 5,925,523 A | 7/1999 | Dove et al. |
| 6,007,988 A | 12/1999 | Choo et al. |
| 6,013,453 A | 1/2000 | Choo et al. |
| 6,040,177 A | 3/2000 | Riddell et al. |
| 6,060,273 A | 5/2000 | Dirks et al. |
| 6,140,081 A | 10/2000 | Barbas et al. |
| 6,183,746 B1 | 2/2001 | Urban et al. |
| 6,200,759 B1 | 3/2001 | Dove et al. |
| 6,207,453 B1 | 3/2001 | Maass et al. |
| 6,355,424 B1 | 3/2002 | Lorincz et al. |
| 6,410,319 B1 | 6/2002 | Raubitschek et al. |
| 6,451,995 B1 | 9/2002 | Cheung et al. |
| 6,453,242 B1 | 9/2002 | Eisenberg et al. |
| 6,534,261 B1 | 3/2003 | Cox et al. |
| 6,582,704 B2 | 6/2003 | Urban et al. |
| 6,602,684 B1 | 8/2003 | Umana et al. |
| 7,070,995 B2 | 7/2006 | Jensen et al. |
| 7,097,843 B2 | 8/2006 | Urban et al. |
| 7,189,513 B2 | 3/2007 | Khleif et al. |
| 7,265,209 B2 | 9/2007 | Jensen et al. |
| 7,354,762 B2 | 4/2008 | Jensen et al. |
| 7,399,467 B2 | 7/2008 | Lu et al. |
| 7,446,179 B2 | 11/2008 | Jensen et al. |
| 7,446,190 B2 | 11/2008 | Jensen et al. |
| 7,446,191 B2 | 11/2008 | Jensen et al. |
| 7,507,538 B2 | 3/2009 | Khleif et al. |
| 7,521,541 B2 | 4/2009 | Eigenbrot et al. |
| 7,569,664 B2 | 8/2009 | Jakobsen et al. |
| 7,855,275 B2 | 12/2010 | Eigenbrot et al. |
| 8,252,893 B2 | 8/2012 | Kim et al. |
| 8,324,353 B2 | 12/2012 | Jensen et al. |
| 8,389,282 B2 | 3/2013 | Sadelain et al. |
| 8,399,645 B2 | 3/2013 | Campana et al. |
| 8,497,118 B2 | 7/2013 | Jensen |
| 8,802,374 B2 | 8/2014 | Jensen et al. |
| 8,865,162 B2 | 10/2014 | Cheng et al. |
| 8,911,993 B2 | 12/2014 | June et al. |
| 8,956,828 B2 | 2/2015 | Bonini et al. |
| 8,968,995 B2 | 3/2015 | Cheng et al. |
| 9,228,007 B1 | 1/2016 | Kitchen et al. |
| 9,273,283 B2 | 3/2016 | Sentman et al. |
| 11,072,660 B2 | 7/2021 | Sissons et al. |
| 11,471,489 B2 | 10/2022 | Goldfless et al. |
| 2002/0131960 A1 | 9/2002 | Sadelain et al. |
| 2002/0164328 A1 | 11/2002 | Shinkawa et al. |
| 2003/0115614 A1 | 6/2003 | Kanda et al. |
| 2003/0157108 A1 | 8/2003 | Presta et al. |
| 2003/0170238 A1 | 9/2003 | Gruenberg et al. |
| 2004/0093621 A1 | 5/2004 | Shitara et al. |
| 2004/0109865 A1 | 6/2004 | Niwa et al. |
| 2004/0110282 A1 | 6/2004 | Kanda et al. |
| 2004/0110704 A1 | 6/2004 | Yamane et al. |
| 2004/0132140 A1 | 7/2004 | Satoh et al. |
| 2005/0123546 A1 | 6/2005 | Umana et al. |
| 2007/0116690 A1 | 5/2007 | Yang et al. |
| 2009/0047660 A1 | 2/2009 | Lu et al. |
| 2009/0117140 A1 | 5/2009 | Nakagawa et al. |
| 2010/0047805 A1 | 2/2010 | Wang et al. |
| 2010/0209904 A1 | 8/2010 | Lu et al. |
| 2011/0003380 A1 | 1/2011 | Miltenyi et al. |
| 2011/0158957 A1 | 6/2011 | Bonini et al. |
| 2011/0207221 A1 | 8/2011 | Cost et al. |
| 2011/0301073 A1 | 12/2011 | Gregory et al. |
| 2012/0164629 A1 | 6/2012 | Lu et al. |
| 2013/0149337 A1 | 6/2013 | Cooper et al. |
| 2013/0287748 A1 | 10/2013 | June et al. |
| 2013/0326645 A1 | 12/2013 | Cost |
| 2014/0219975 A1 | 8/2014 | June et al. |
| 2014/0301990 A1 | 10/2014 | Gregory et al. |
| 2015/0056705 A1 | 2/2015 | Conway et al. |
| 2015/0093742 A1 | 4/2015 | Lu et al. |
| 2015/0098954 A1 | 4/2015 | Hyde et al. |
| 2015/0164954 A1 | 6/2015 | Bonini et al. |
| 2015/0203817 A1 | 7/2015 | Galetto et al. |
| 2016/0083449 A1 | 3/2016 | Schmitt et al. |
| 2016/0152681 A1 | 6/2016 | Hinrichs et al. |
| 2016/0208243 A1 | 7/2016 | Zhang et al. |
| 2016/0272999 A1 | 9/2016 | Duchateau et al. |
| 2017/0016025 A1 | 1/2017 | Poirot et al. |
| 2017/0016027 A1 | 1/2017 | Lee et al. |
| 2017/0088895 A1 | 3/2017 | Han et al. |
| 2017/0145070 A1 | 5/2017 | Hinrichs et al. |
| 2017/0211075 A1 | 7/2017 | Lee et al. |
| 2017/0290858 A1 | 10/2017 | Zhao et al. |
| 2017/0312350 A1 | 11/2017 | Maurer et al. |
| 2018/0362975 A1 | 12/2018 | Chen et al. |
| 2019/0225692 A1 | 7/2019 | Sissons et al. |
| 2019/0321401 A1 | 10/2019 | Goldfless et al. |
| 2021/0015869 A1 | 1/2021 | Burleigh et al. |
| 2021/0017249 A1 | 1/2021 | Sather et al. |
| 2021/0363258 A1 | 11/2021 | Sissons et al. |
| 2023/0140802 A1* | 5/2023 | Chaudhary ........... C07K 14/705 424/93.21 |
| 2023/0256018 A1 | 8/2023 | Goldfless et al. |

FOREIGN PATENT DOCUMENTS

| | | |
|---|---|---|
| EP | 0452342 | 10/1991 |
| EP | 1708745 | 4/2012 |
| EP | 2537416 | 12/2012 |
| JP | 2007-522108 | 8/2007 |
| JP | 2017-081836 | 5/2017 |
| WO | WO 1992/008796 | 5/1992 |
| WO | WO 1994/028143 | 12/1994 |
| WO | WO 1995/019431 | 7/1995 |
| WO | WO 1996/006166 | 2/1996 |
| WO | WO 1996/013593 | 5/1996 |
| WO | WO 1996/018105 | 6/1996 |
| WO | WO 1997/030087 | 8/1997 |
| WO | WO 1998/054311 | 3/1998 |
| WO | WO 1998/053057 | 11/1998 |
| WO | WO 1998/053058 | 11/1998 |
| WO | WO 1998/053059 | 11/1998 |
| WO | WO 1998/053060 | 11/1998 |
| WO | WO 1998/058964 | 12/1998 |
| WO | WO 1999/018129 | 4/1999 |
| WO | WO 1999/022764 | 5/1999 |
| WO | WO 1999/060120 | 11/1999 |
| WO | WO 2000/014257 | 3/2000 |
| WO | WO 2000/027878 | 5/2000 |
| WO | WO 2000/061739 | 10/2000 |
| WO | WO 2000/067761 | 11/2000 |
| WO | WO 2001/029246 | 4/2001 |
| WO | WO 2001/060970 | 8/2001 |
| WO | WO 2001/088197 | 11/2001 |
| WO | WO 2002/016536 | 2/2002 |
| WO | WO 2002/031140 | 4/2002 |
| WO | WO 2002/077012 | 10/2002 |
| WO | WO 2002/099084 | 12/2002 |
| WO | WO 2003/011878 | 2/2003 |
| WO | WO 2003/016496 | 2/2003 |
| WO | WO 2003/020763 | 3/2003 |
| WO | WO 2003/084570 | 10/2003 |
| WO | WO 2003/085107 | 10/2003 |
| WO | WO 2003/085119 | 10/2003 |
| WO | WO 2004/033685 | 4/2004 |
| WO | WO 2004/056312 | 7/2004 |
| WO | WO 2005/035586 | 4/2005 |
| WO | WO 2005/035778 | 4/2005 |
| WO | WO 2005/053742 | 6/2005 |
| WO | WO 2006/000830 | 1/2006 |
| WO | WO 2006/037960 | 4/2006 |
| WO | WO 2006/059529 | 6/2006 |
| WO | WO 2008/121420 | 10/2008 |
| WO | WO 2008/147187 | 12/2008 |
| WO | WO 2009/120022 | 1/2009 |
| WO | WO 2009/072003 | 6/2009 |
| WO | WO 2009/148229 | 12/2009 |
| WO | WO 2009/148230 | 12/2009 |

(56) References Cited

FOREIGN PATENT DOCUMENTS

| WO | WO 2010/033140 | 3/2010 | | |
|---|---|---|---|---|
| WO | WO 2010/123561 | 10/2010 | | |
| WO | WO 2011/044186 | 4/2011 | | |
| WO | WO 2011/101122 | 8/2011 | | |
| WO | WO 2012/048340 | 4/2012 | | |
| WO | WO 2012/048341 | 4/2012 | | |
| WO | WO 2012/036437 | 6/2012 | | |
| WO | WO 2012/129514 | 9/2012 | | |
| WO | WO 2013/037695 | 3/2013 | | |
| WO | WO 2013/063361 | 5/2013 | | |
| WO | WO 2013/071154 | 5/2013 | | |
| WO | WO 2013/074916 | 5/2013 | | |
| WO | WO 2013/123061 | 8/2013 | | |
| WO | WO 2013/126726 | 8/2013 | | |
| WO | WO 2013/166321 | 11/2013 | | |
| WO | WO 2013/169386 | 11/2013 | | |
| WO | WO 2014/031687 | 2/2014 | | |
| WO | WO 2014/055668 | 4/2014 | | |
| WO | WO 2014/096803 | 6/2014 | | |
| WO | WO 2014/134165 | 9/2014 | | |
| WO | WO 2014/153470 | 9/2014 | | |
| WO | WO 2014/191128 | 12/2014 | | |
| WO | WO 2015/009604 | 1/2015 | | |
| WO | WO 2015/009606 | 1/2015 | | |
| WO | WO 2015/010347 | 1/2015 | | |
| WO | WO 2015/018943 | 2/2015 | | |
| WO | WO 2015/066551 | 5/2015 | | |
| WO | WO 2015/136001 | 9/2015 | | |
| WO | WO 2015/143558 | 10/2015 | | |
| WO | WO 2015/161276 | 10/2015 | | |
| WO | WO 2015/164740 | 10/2015 | | |
| WO | WO 2015/184228 | 12/2015 | | |
| WO | WO-2015184228 A1 * | 12/2015 | ......... | A61K 38/1774 |
| WO | WO 2016/007175 | 1/2016 | | |
| WO | WO 2016/014565 | 1/2016 | | |
| WO | WO 2016/016341 | 2/2016 | | |
| WO | WO 2016/044227 | 3/2016 | | |
| WO | WO 2016/055785 | 4/2016 | | |
| WO | WO 2016/069282 | 5/2016 | | |
| WO | WO 2016/069283 | 5/2016 | | |
| WO | WO 2016/146618 | 9/2016 | | |
| WO | WO 2016/182957 | 11/2016 | | |
| WO | WO 2017/011519 | 1/2017 | | |
| WO | WO 2017/062451 | 4/2017 | | |
| WO | WO 2017/064198 | 4/2017 | | |
| WO | WO 2017/070429 | 4/2017 | | |
| WO | WO 2017/093969 | 6/2017 | | |
| WO | WO 2017/106528 | 6/2017 | | |
| WO | WO 2017/163064 | 9/2017 | | |
| WO | WO 2017/175006 | 10/2017 | | |
| WO | WO 2017/193107 | 11/2017 | | |
| WO | WO 2018/005556 | 1/2018 | | |
| WO | WO 2018/005559 | 1/2018 | | |
| WO | WO 2018/027036 | 2/2018 | | |
| WO | WO 2018/050818 | 3/2018 | | |
| WO | WO 2018/067618 | 4/2018 | | |
| WO | WO 2018/073393 | 4/2018 | | |
| WO | WO 2018/178378 | 10/2018 | | |
| WO | WO 2018/208837 | 11/2018 | | |
| WO | WO 2019/005897 | 1/2019 | | |
| WO | WO 2019/005957 | 1/2019 | | |
| WO | WO 2019/097305 | 5/2019 | | |
| WO | WO 2019/195486 | 10/2019 | | |
| WO | WO 2019/195491 | 10/2019 | | |
| WO | WO 2019/195492 | 10/2019 | | |

OTHER PUBLICATIONS

Draper et al in "Targeting of HPV-16+ Epithelial Cancer Cells by TCR Gene Engineered T Cells Directed against E6" (Clinical Cancer Research, Oct. 1, 2015, vol. 21, No. 19, pp. 4431-4439). (Year: 2015).*

Liu et al in "Rapid induction of cytotoxic T-cell response against cervical cancer cells by human papillomavirus type 16 E6 antigen gene delivery into human dendritic cells by an adeno-associated virus vector" (Cancer Gene Therapy vol. 8, No. 12, Dec. 2001, pp. 948-957). (Year: 2001).*

Monjezi et al in "Enhanced CAR T-cell engineering using non-viral Sleeping Beauty transposition from minicircle vectors" (Leukemia 2017 vol. 31, pp. 186-194). (Year: 2017).*

Li et al in "Adeno-associated virus vectors: potential applications for cancer gene therapy" Cancer Gene Therapy 2005 vol. 12, pp. 913-925). (Year: 2005).*

Banu et al in "Building and Optimizing a Virus-specific T Cell Receptor Library for Targeted Immunotherapy in Viral Infections" (Scientific Reports vol. 4, pp. 1-10, published Feb. 25, 2014). (Year: 2014).*

Score report for instant SEQ ID No. 1344 for Chaudhary US2023/0140802 reference. (Year: 2023).*

Alonso-Camino et al., "CARbodies: Human Antibodies Against Cell Surface Tumor Antigens Selected From Repertoires Displayed on T Cell Chimeric Antigen Receptors," Mol Ther Nucl Acids (2013) 2(5): e93.

Anders et al., "Structural basis of PAM-dependent target DNA recognition by the Cas9 endonuclease," Nature (2014) 513(7519):569-73.

Bae et al., "Cas-OFFinder: a fast and versatile algorithm that searches for potential off-target sites of Cas9 RNA-guided endonucleases," Bioinformatics (2014) 30(10):1473-5.

Banu et al., "Building and Optimizing a Virus-specific T Cell Receptor Library for Targeted Immunotherapy in Viral Infections." Sci Rep. Feb. 25, 2014;4:4166.

Binkowski et al., "Predicting HLA Class I Non-Permissive Amino Acid Residues Substitutions." PLoS ONE 2012. 7(8): e41710.

Boris-Lawrie et al., "Recent advances in retrovirus vector technology," Cur. Opin. Genet. Develop. (1993) 3:102-109.

Brash et al., "Strontium phosphate transfection of human cells in primary culture: stable expression of the simian virus 40 large-T-antigen gene in primary human bronchial epithelial cells," Mol. Cell Biol., (1987) 7: 2031-2034.

Briner et al., "Guide RNA functional modules direct Cas9 activity and orthogonality," Molecular Cell, (2014) 56(2):333-339.

Burns et al., "Vesicular stomatitis virus G glycoprotein pseudotyped retroviral vectors: concentration to very high titer and efficient gene transfer into mammalian and nonmammalian cells," Proc. Natl. Acad. Sci. USA, (1993) 90:8033-8037.

Caldecott, "Single-strand break repair and genetic disease," Nature Reviews Genetics, (2008) 9(8):619-631.

Cameron et al., "Identification of a Titin-derived HLA-A1-presented peptide as a cross- reactive target for engineered MAGE A3-directed T cells." Sci Transl Med. Aug. 7, 2013;5(197):197ra103.

Campillo-Davo et al., "Efficient and Non-genotoxic RNA-Based Engineering of Human T Cells Using Tumor-Specific T Cell Receptors With Minimal TCR Mispairing." Front Immunol. Nov. 7, 2018;9:2503.

Carlens et al., "Ex vivo T lymphocyte expansion for retroviral transduction: influence of serum-free media on variations in cell expansion rates and lymphocyte subset distribution," Exp Hematol., (2000) 28(10):1137-46.

Cavalieri et al., "Human T lymphocytes transduced by lentiviral vectors in the absence of TCR activation maintain an intact immune competence," Blood, (2003) 102(2):497- 505.

Challita et al., "Multiple modifications in cis elements of the long terminal repeat of retroviral vectors lead to increased expression and decreased DNA methylation in embryonic carcinoma cells," J. Virol., (1995) 69(2):748-755.

Chang et al., "Modification of DNA ends can decrease end joining relative to homologous recombination in mammalian cells," Proc. Natl. Acad. Sci. USA, (1987) 84:4959-4963.

Cheever et al., "The prioritization of cancer antigens: a national cancer institute pilot project for the acceleration of translational research." Clin Cancer Res. Sep. 1, 2009;15(17):5323-37.

Chervin et al., "Engineering higher affinity T cell receptors using a T cell display system," J Immunol Methods, (2008) 339(2):175-84.

Chicaybam et al., "An Efficient Low Cost Method for Gene Transfer to T Lymphocytes," PLoS ONE, (2013) 8(3): e60298.

(56) References Cited

OTHER PUBLICATIONS

Cho et al., "Human mammalian cell sorting using a highly integrated micro-fabricated fluorescence-activated cell sorter (μFACS)," Lab Chip, (2010) 10(12):1567-1573.
Chothia et al., "The outline structure of the T-cell alpha beta receptor," EMBO J., (1988) 7(12):3745-3755.
Chowdhury, "Engineering hot spots for affinity enhancement of antibodies," Methods Mol. Biol. 207:179-196 (2008).
Chylinski et al., "The tracrRNA and Cas9 families of type II CRISPR-Cas immunity systems," RNA Biol., (2013) 10(5): 726-737.
Clackson et al., "Making antibody fragments using phage display libraries," Nature, (1991) 352(6336):624-628.
Clinical Trial Study Record No. NCT01462838. Updated Jun. 23, 2015. Accessed Jun. 20, 2019.
Clinical Trial Study Record No. NCT02280811. Updated Sep. 6, 2017. Accessed Mar. 28, 2019.
Clinical Trial Study Record No. NCT02291055. Updated in Mar. 14, 2018. Accessed Jun. 20, 2019.
Clinical Trial Study Record No. NCT02379520. Updated Dec. 13, 2019. Accessed Mar. 28, 2019.
Clinical Trial Study Record No. NCT02426892. Updated in May 10, 2019. Accessed Jun. 20, 2019.
Clinical Trial Study Record No. NCT02526316. Updated in Jul. 2, 2017. Accessed Jun. 20, 2019.
Clinical Trial Study Record No. NCT02858310. Updated Mar. 18, 2019. Accessed Mar. 28, 2019.
Clinical Trial Study Record No. NCT03260023. Updated in Mar. 21, 2019. Accessed Jun. 20, 2019.
Clinical Trial Study Record No. NCT03439085. Updated in May 29, 2019. Accessed Jun. 20, 2019.
Cong et al., "Multiplex genome engineering using CRISPR/Cas systems," Science, (2013) 399(6121):819-823.
Cooper et al., "T-cell clones can be rendered specific for CD19: toward the selective augmentation of the graft-versus-B-lineage leukemia effect," Blood, (2003) 101:1637-1644.
Croft et al., "Targeted Insertion of an HPV-16 E7-Specific Engineered T Cell Receptor into the TRAC Locus." Cancer Immunol. Res.Feb. 1, 2019;7(2 Suppl.):Abstract nr A027.
Croft et al., "Targeted Insertion of an HPV-16 E7-Specific Engineered T Cell Receptor into the TRAC Locus." Poster, presented at AACR 2018 on Apr. 14, 2018.
Daniel-Meshulam et al., "How (specific) would like your T-cells today? Generating T-cell therapeutic function through TCR-gene transfer." Front Immunol. Jul. 6, 2012;3:186.
Davila et al., "CD19 CAR—Targeted T Cells Induce Long-Term Remission and B Cell Aplasia in an Immunocompetent Mouse Model of B Cell Acute Lymphoblastic Leukemia," PLoS ONE, (2013) 8(4): e61338.
De Castro et al., "ScanProsite: detection of PROSITE signature matches and ProRule-associated functional and structural residues in proteins.," Nucleic Acids Res. (2006); 34(Web Server issue):W362-5.
De Felipe et al., "Targeting of proteins derived from self-processing polyproteins containing multiple signal sequences," Traffic, (2004) 5(8):616-626.
De Felipe, "Skipping the co-expression problem: the new 2A "CHYSEL" technology," Genetic Vaccines and Ther., (2004) 2:13.
Deveau et al., "Phage response to CRISPR-encoded resistance in *Streptococcus thermophilus*," J Bacteriol, (2008) 190(4):1390-1400.
Draper et al., "Targeting of HPV-16+ Epithelial Cancer Cells by TCR Gene Engineered T Cells Directed against E6," Clinical Cancer Research, (2015) 21(19):4431-4439.
Ehrenmann et al., "IMGT/3Dstructure-DB and IMGT/DomainGapAlign: a database and a tool for immunoglobulins or antibodies, T cell receptors, MHC, IgSF and MhcSF." Nucleic Acids Res. Jan. 2010;38(Database issue):D301-7.
Endo et al., "High-throughput, genome-scale protein production method based on the wheat germ cell-free expression system," Biotechnol. Adv., (2003) 21:695-713.
Esvelt et al., "A system for the continuous directed evolution of biomolecules," Nature, (2011) 472(7344):499-503.
Fedorov et al., "PD-1- and CTLA-4-based inhibitory chimeric antigen receptors (iCARs) divert off-target immunotherapy responses," Sci. Transl. Medicine, (2013) 5(215):215RA172.
Flatman et al., "Process analytics for purification of monoclonal antibodies," J. Chromatogr. B, (2007) 848(1):79-87.
Fu et al., "Improving CRISPR-Cas nuclease specificity using truncated guide RNAs," Nat Biotechnol, (2014) 32(3):279-284.
Garcillian. "List of Jurkat derived cells lines deficient in some TCR subunits" (2015) Retrieved from https://www.researchgate.net/post/Are_there_any_human_T_cell_lines_defective_for_both_the_alpha_and_beta_TCR_subunits/54c2262fd5a3f2fd0e8b4635/citation/download. Retrieved on Jun. 23, 2020.
Gerngross, "Advances in the production of human therapeutic proteins in yeasts and filamentous fungi," Nat. Biotech., (2004) 22(11):1409-1414.
Godin et al., "Microfluidics and photonics for Bio-System-on-a-Chip: a review of advancements in technology towards a microfluidic flow cytometry chip," J Biophoton., (2008) 1(5):355-376.
Haft et al., "A Guild of 45 CRISPR-Associated (Cas) Protein Families and Multiple CRISPR/Cas Subtypes Exist in Prokaryotic Genomes," PLOS Computational Biology, (2005), 1(6):e60.
Haga-Friedman et al., "Incorporation of transmembrane hydrophobic mutations in the TCR enhance its surface expression and T cell functional avidity," Journal of Immunology, (2012) 188:5538-5546.
Heigwer et al., "E-CRISP: fast CRISPR target site identification," Nat Methods, (2014) 11(2):122-3.
Hermans et al., "The VITAL assay: a versatile fluorometric technique for assessing CTL- and NKT-mediated cytotoxicity against multiple targets in vitro and in vivo," J. Immunological Methods, 285(1): 25-40 (2004).
Hinrichs et al., "A phase I/II clinical trial of E6 T-cell receptor gene therapy for human papillomavirus (HPV)—associated epithelial cancers." J Clin Oncol 35, 2017 (suppl; abstr 3009).
Ho et al., "In vitro methods for generating CD8+ T-cell clones for immunotherapy from the naïve repertoire," J. Immunol. Methods, (2006) 310(1-2):40-52.
Ho et al., "Cytolytic CD8+ T cells directed against a cryptic epitope derived from a retroviral alternative reading frame confer disease protection." J Immunol. Feb. 15, 2006;176(4):2470-5.
Hoogenboom et al. in Methods in Molecular Biology 178:1-37 (O'Brien et al., ed., Human Press, Totowa, NJ, (2001).
Holler et al., "In vitro evolution of a T cell receptor with high affinity for peptide/MHC," Proc Natl Acad Sci USA, (2000) 97(10):5387-92.
Holler et al., "TCRs with high affinity for foreign pMHC show self-reactivity," Nat Immunol, (2003) 4(1):55-62.
Horvath et al., "CRISPR/Cas, the immune system of bacteria and archaea," Science (2010); 327(5962):167-170.
Hou et al., "Efficient genome engineering in human pluripotent stem cells using Cas9 from Neisseria meningitidis," PNAS, (2013) 110(39):15644-9.
Hsu et al., "DNA targeting specificity of RNA-guided Cas9 nucleases," Nat Biotechnol, (2013) 31(9):827-32.
Huang et al., "DNA Transposons for Modification of Human Primary T Lymphocytes," In: Baum C. (eds) Genetic Modification of Hematopoietic Stem Cells. Methods In Molecular Biology™, vol. 506. Humana Press. (2009) 115-126.
Hudecek et al., "Receptor Affinity and Extracellular Domain Modifications Affect Tumor Recognition by ROR1-Specific Chimeric Antigen Receptor T Cells," Clin. Cancer Res., (2013) 19(12):3153-3164.
Janeway et al., Immunobiology: The Immune System in Health and Disease, 3rd Ed., Current Biology Publications, p. 4:33, 1997.
Jinek et al., "A Programmable Dual-RNA-Guided DNA Endonuclease in Adaptive Bacterial Immunity," Science (2012), 337(6096):816-821.

(56) References Cited

OTHER PUBLICATIONS

Jinek et al., "Structures of Cas9 endonucleases reveal RNA-mediated conformational activation," Science, (2014) 343(6176):1247997.
Johnston, "Biolistic transformation: microbes to mice," Nature, (1990) 346: 776-777.
Jones et al., "Distinct CDR3 conformations in TCRs determine the level of cross-reactivity for diverse antigens, but not the docking orientation." J Immunol. Nov. 1, 2008;181(9):6255-64.
Jores et al., "Resolution of hypervariable regions in T-cell receptor beta chains by a modified Wu-Kabat index of amino acid diversity," Proc. Nat'l Acad. Sci. USA, (1990) 87(23):9138-42.
Joyce et al., "T Cell Exclusion, Immune Privilege, and the Tumor Microenvironment." Science Apr. 3, 2015;342(6230);74-80.
Kanda et al., "Comparison of cell lines for stable production of fucose-negative antibodies with enhanced ADCC," Biotechnol. Bioeng., (2006) 94(4):680-688.
Kerry et al., "Interplay between TCR Affinity and Necessity of Coreceptor Ligation: High-Affinity Peptide-MHC/TCR Interaction Overcomes Lack of CD8 Engagement," J. Immunology, (2003) 171(9): 4493-4503.
Kerry et al., "Memory CD8+ T cells require CD8 coreceptor engagement for calcium mobilization and proliferation, but not cytokine production," Immunology (2005) 114(1):44-52.
Kessels et al., "Generation of T cell help through a MHC class I-restricted TCR." J Immunol. Jul. 15, 2006;177(2):976-82.
Kindt et al. Kuby Immunology, 6th ed., W.H. Freeman and Co., p. 91 (2007).
Klebanoff et al., "Sorting through subsets: Which T cell populations mediate highly effective adoptive immunotherapy?" J Immunother., (2012) 35(9):651-660.
Kochenderfer et al., "Construction and preclinical evaluation of an anti-CD19 chimeric antigen receptor," J. Immunotherapy, (2009) 32(7):689-702.
Koste et al., "T-cell receptor transfer into human T cells with ecotropic retroviral vectors," Gene Therapy, (2014) 21(5):533-8.
Kotb, "Bacterial pyrogenic exotoxins as superantigens," Clinical Microbiology Reviews, (1995) 8:411-426.
Kuball et al., "Facilitating matched pairing and expression of TCR chains introduced into human T cells," Blood, (2007) 109:2331-2338.
Lee, et al., "Nonendocytic delivery of functional engineered nanoparticles into the cytoplasm of live cells using a novel, high-throughput microfluidic device," Nano Lett, (2012) 12(12):6322-7.
Lefranc et al., "IMGT unique numbering for immunoglobulin and T cell receptor variable domains and Ig superfamily V-like domains," Developmental and Comparative Immunology, (2003) 27(1):55-77.
Li et al., "Directed evolution of human T-cell receptors with picomolar affinities by phage display," Nat Biotechnol, (2005) 23(3):349-54.
Li et al., "Optimization of humanized IgGs in glycoengineered Pichia pastoris," Nat. Biotech., (2006) 24(2):210-215.
Liu et al., "Inclusion of Strep-Tag II in design of antigen receptors for T cell immunotherapy," Nature Biotech., (2016) 34(4): 430-434.
Lloyd et al., "Beyond the Antigen Receptor: Editing the Genome of T-Cells for Cancer Adoptive Cellular Therapies," Frontiers in Immunology, (2013) 4(221):1-7.
Lupton et al., "Dominant positive and negative selection using a hygromycin phosphotransferase-thymidine kinase fusion gene," Mol. and Cell Biol., (1991) 11(6):3374-8.
Lyford-Pike et al., "Evidence for a Role of the PD-1:PD-L1 Pathway in Immune Resistance of HPV-Associated Head and Neck Squamous Cell Carcinoma." Cancer Res. Mar. 15, 2013;73(6):1733-41.
Maeder et al., "Genome-editing Technologies for Gene and Cell Therapy," Mol Ther. (2016) 24(3): 430-46.
Makarova et al., "Evolution and classification of the CRISPR-Cas systems," Nature Review Microbiology, (2011) 9(6):467-477.
Mali et al., "RNA-guided human genome engineering via Cas9," Science, (2013) 339(6121):823-826.
Manuri et al., "piggyBac Transposon/Transposase System to Generate CD19-Specific T Cells for the Treatment of B-Lineage Malignancies," Hum Gene Ther, (2010) 21(4):427-437.
Marteijn et al., "Understanding nucleotide excision repair and its roles in cancer and ageing," Nature Reviews Molecular Cell Biology, (2014) 15(7):465-481.
Methods in Molecular Medicine, vol. 58: Metastasis Research Protocols, vol. 2: Cell Behavior In Vitro and In Vivo, p. 17-25 Edited by: S. A. Brooks and U. Schumacher © Humana Press Inc., Totowa, NJ.
Miller and Rosman, "Improved retroviral vectors for gene transfer and expression," BioTechniques, (1989) 7(9):980-990.
Miller, "Retrovirus packaging cells," Human Gene Therapy, (1990) 1(1):5-14.
Moran et al., "T cell receptor signal strength in Treg and iNKT cell development demonstrated by a novel fluorescent reporter mouse." J Exp Med. Jun. 6, 2011;208(6):1279-89.
Mullen et al., "Transfer of the bacterial gene for cytosine deaminase to mammalian cells confers lethal sensitivity to 5-fluorocytosine: A negative selection system," Proc. Natl. Acad. Sci. USA, (1992) 89:33-37.
Nagarsheth et al., "Regression of epithelial cancers in humans following T-cell receptor gene therapy targeting human papillomavirus-16 E7." J. Clin. Oncology May 20, 2018;36(15 suppl):3043-3043.
Nehls et al., "Two genetically separable steps in the differentiation of thymic epithelium," Science, (1996) 272(5263):886-889.
Nilges et al., "Human papillomavirus type 16 E7 peptide-directed CD8+ T cells from patients with cervical cancer are cross-reactive with the coronavirus NS2 protein," J Virol. May 2003;77(9):5464-74.
Nishimasu et al., "Crystal structure of Cas9 in complex with guide RNA and target DNA," Cell, (2014) 156(5):935-949.
Norberg et al., "Regression of Epithelial Cancers Following T Cell Receptor Gene Therapy Targeting Human Papillomavirus-16 E7." Blood 2018 132:492.
Okazaki et al., "Fucose depletion from human IgG1 oligosaccharide enhances binding enthalpy and association rate between IgG1 and FcgammaRIIIa," J. Mol. Biol., (2004) 336(5):1239-1249.
Osborn et al., "Evaluation of TCR Gene Editing Achieved by TALENs, CRISPR/Cas9, and megaTAL Nucleases," Mol. Ther., (2016) 24(3):570-581.
Park et al., "Treating cancer with genetically engineered T cells," Trends Biotechnol., (2011) 29(11):550-557.
Portolano et al., "Lack of promiscuity in autoantigen-specific H and L chain combinations as revealed by human H and L chain "roulette".," J. Immunol., (1993), 150:880-887.
Protocol Details "A Phase I/II Trial of T Cell Receptor Gene Therapy Targeting HPV-16 E7 with or without PD-1 Blockade for HPV-Associated Cancers." Record No. 16-C- 0154; retrieved from https://clinicalstudies.info.nih.gov/ProtocolDetails.aspx?A_2016-C- 0154.html; retrieved on Mar. 28, 2019.
Riddell et al., "Phase I study of cellular adoptive immunotherapy using genetically modified CD8+ HIV-specific T cells for HIV seropositive patients undergoing allogeneic bone marrow transplant," Human Gene Therapy, (1992) 3:319-338.
Riemer et al., "A conserved E7-derived cytotoxic T lymphocyte epitope expressed on human papillomavirus 16-transformed HLA-A2+ epithelial cancers," J Biol Chem (2010) 285(38):29608-29622.
Ripka et al., "Two Chinese hamster ovary glycosylation mutants affected in the conversion of GDP-mannose to GDP-fucose," Arch. Biochem. Biophys., (1986) 249(2):533-545.
Robbins et al., "Single and dual amino acid substitutions in TCR CDRs can enhance antigen-specific T cell functions," J Immunology, (2008) 180(9): 6116-6131.
Rosenberg, "Cell transfer immunotherapy for metastatic solid cancer—what clinicians need to know," Nat Rev Clin Oncol., (2011) 8(10):577-85.
Sadelain et al., "The basic principles of chimeric antigen receptor design," Cancer Discov. (2013) 3(4): 388-398.
Sander and Joung, "CRISPR-Cas systems for editing, regulating and targeting genomes," Nature Biotechnology, (2014) 32(4): 347-355.

(56) References Cited

OTHER PUBLICATIONS

Sanjana et al., "Improved vectors and genome-wide libraries for CRISPR screening," Nat. Methods, (2014) 11(8):783-4.
Scarpa et al., "Characterization of recombinant helper retroviruses from Moloney—based vectors in ecotropic and amphotropic packaging cell lines," Virology, (1991) 180(2):849-852.
Scatchard et al., "The Attractions of Proteins For Small Molecules and Ions," Ann. N.Y. Acad. Sci., (1949) 51(4):660-672.
Schlueter et al., "Specificity and binding properties of a single-chain T cell receptor," J. Mol. Biol., (1996) 256(5):859-69.
Sharma et al., "Efficient Sleeping Beauty DNA Transposition From DNA Minicircles," Molec Ther Nucl Acids, (2013) 2(2):e74.
Sitaraman et al., "High-throughput protein expression using cell-free system," Methods Mol. Biol., (2009) 498: 229-44.
Spirin, "High-throughput cell-free systems for synthesis of functionally active proteins," Trends Biotechnol., (2004) 22(10):538-45.
Sternberg et al., "DNA interrogation by the CRISPR RNA-guided endonuclease Cas9," Nature, (2014) 507(7490):62-7.
Stone et al., "Role of T cell receptor affinity in the efficacy and specificity of adoptive T cell therapies." Front Immunol. Aug. 21, 2013;4:244.
Stone et al., "T cell receptor binding affinities and kinetics: impact on T cell activity and specificity," Immunology. Feb. 2009;126(2):165-76.
Stone et al., "Opposite effects of Endogenous Peptide-MHC Class I on T Cell Activity in the Presence and Absence of CD8." J Immunol. 2011 186(9); 5193-200.
Swarts et al., "DNA-guided DNA interference by a prokaryotic Argonaute," Nature, (2014) 507(7491):258-261.
Szoka et al., "Comparative properties and methods of preparation of lipid vesicles (liposomes)," Ann. Rev. Biophys. Bioeng., (1980) 9:467-508.
Tang et al., "The advantages of PD1 activating chimeric receptor (PD1-ACR) engineered lymphocytes for PDL1+ cancer therapy," Am J Transl Res., (2015) 7(3):460-473.
Terakura et al., "Generation of CD19-chimeric antigen receptor modified CD8+ T cells derived from virus-specific central memory T cells," Blood, (2012) 119:72-82.
Themeli et al., "Generation of tumor-targeted human T lymphocytes from induced pluripotent stem cells for cancer therapy," Nat Biotechnol., (2013) 31(10): 928-933.
Thomas et al., "Molecular immunology lessons from therapeutic T-cell receptor gene transfer." Immunology. Feb. 2010; 129(2):170-7.
Torikai et al., "A foundation for universal T-cell based immunotherapy: T cells engineered to express a CD19-specific chimeric-antigen-receptor and eliminate expression of endogenous TCR," Blood, (2012) 119(24):5697-5705.
Tsang et al., "Identification and Characterization of Enhancer Agonist Human Cytotoxic T-cell Epitopes of the Human Papillomavirus Type 16 (HPV16) E6/E7" Vaccine (2017) 35(19): 2605-2611.
Tsukahara et al., "CD19 target-engineered T-cells accumulate at tumor lesions in human B-cell lymphoma xenograft mouse models," Biochem Biophys Res Commun, (2013) 438(1): 84-9.
Turtle et al., "Engineered T cells for anti-cancer therapy," Curr. Opin. Immunol., (2012) 24(5): 633-39.
Van Loenen et al., "Mixed T cell receptor dimers harbor potentially harmful neoreactivity." Proc Natl Acad Sci U S A. Jun. 15, 2010;107(24):10972-7.
Van Tendeloo et al., "High-level transgene expression in primary human T lymphocytes and adult bone marrow CD34+ cells via electroporation-mediated gene delivery," Gene Therapy, (2000) 7(16):1431-1437.
Verhoeyen et al., "Lentiviral vector gene transfer into human T cells," Methods Mol Biol., (2009) 506:97-114.
Wadhwa et al., "Receptor mediated glycotargeting," J. Drug Targeting, (1995) 3(2):111-27.
Wang et al., "One-step generation of mice carrying mutations in multiple genes by CRISPR/Cas-mediated genome engineering," Cell, (2013) 153(4):910-918.

Wang et al., "Phenotypic and Functional Attributes of Lentivirus Modified CD19-specific Human CD8+ Central Memory T Cells Manufactured at Clinical Scale," J Immunother., (2012) 35(9):689-701.
Weiss et al., "Requirement for the coexpression of T3 and the T cell antigen receptor on a malignant human T cell line," J. Ex. Med., (1984) 160(5):1284-1299.
Wigler et al., "Transfer of purified herpes virus thymidine kinase gene to cultured mouse cells," Cell (1977) 11(1):223-32.
Wilson, "Tech.Sight. Analyzing biomolecular interactions," Science, (2002) 295(5562):2103-5.
Wolff et al., "Monoclonal antibody homodimers: enhanced antitumor activity in nude mice," Cancer Res., (1993) 53(11):2560-2565.
Wu et al., "Adoptive T-cell therapy using autologous tumor-infiltrating lymphocytes for metastatic melanoma: current status and future outlook," Cancer, (2012) 18(2):160-75.
Xiao A et al., "CasOT: a genome-wide Cas9/gRNA off-target searching tool," Bioinformatics, (2014) 30(8):1180-1182.
Yamane-Ohnuki et al., "Establishment of FUT8 knockout Chinese hamster ovary cells: An ideal host cell line for producing completely defucosylated antibodies with enhanced antibody-dependent cellular cytotoxicity," Biotech. Bioeng., (2004) 87(5):614-622.
Yamano et al., "Crystal Structure of Cpf1 in Complex with Guide RNA and Target DNA," Cell (2016) 165(4):949-962.
Youde et al., "Use of Fluorogenic Histocompatibility Leukocyte Antigen-A*0201/HPV 16 E7 Peptide Complexes to Isolate Rare Human Cytotoxic T-Lymphocyte-recognizing Endogenous Human Papillomavirus Antigens." Cancer Research Jan. 15, 2000;60:365-371.
Zetsche et al., "Cpf1 is a single RNA-guided endonuclease of a class 2 CRISPR-Cas system," Cell, (2015) 163(3):759-771.
Albers et al. "Gene editing enables T-cell engineering to redirect antigen specificity for potent tumor rejection." *Life science alliance* 2.2 (2019).
Brunner. "Cytotoxic T cells: double-barreled shot guns." *Nature medicine* 5.1 (1999):20-20.
Mariuzza et al., The structural basis of antigen-antibody recognition, Ann. Rev. Biophys. Biophys. Chem., 1987, vol. 16, pp. 139-159.
Salyaev et al. "The study of immunogenicity of the antigenic protein of high risk oncogenic type of the human papillomavirus HPV16 L1 produced in the plant expression system on the base of transgenic tomato." Doklady Biochemistry and Biophysics. vol. 474. No. 1. Pleiades Publishing, 2017. 186 abstract.
Salyaev et al. "Cross-reactivity of antigens and antibodies belonging to different pathogenic types of human papillomaviruses." *Doklady Biochemistry and Biophysics*. vol. 477. No. 1. Pleiades Publishing, 2017. 372 abstract.
U.S. Appl. No. 17/855,380, filed Jun. 30, 2022, by Goldfless et al.
Coico et al., "Immunology" translation from English, edited by N.B. Serebryanaya, Moscow, "Akademiya", 2008, p. 37 [In Russian w/English translation].
Eyquem et al., "Targeting a CAR to the TRAC locus with CRISPR/Cas9 enhances tumour rejection," Nature (2017) 543(7643):113-117.
Hartmann J et al., "Clinical development of CAR T cells-challenges and opportunities in translating innovative treatment concepts," EMBO Mol Med. (2017) 9(9); 1183-1197.
Hale et al., "Homology-Directed Recombination for Enhanced Engineering of Chimeric Antigen Receptor T Cells," Mol Ther Methods Clin Dev (2017) 4:192-203.
Im et al., "Immunotherapy in hematologic malignancies: past, present, and future," J Hematol Oncol. (2017) 10(1):94.
Kuznetsova, Parenthesis in Text of Legal Document as a Linguo-Cognitive Phenomenon [in Russian], Vestnik MGOU. Series: Russian Philology, 2015, N3, pp. 37-43 [In Russian; English abstract].
Lee et al., "Efficient generation of CAR T cells by site-specific gene addition into the TRAC locus." Cancer Res Jul. 1, 2017 (77) (13 Supplement) Abstract 3756.
Liu et al., "CRISPR-Cas9-mediated multiplex gene editing in CAR-T cells," Cell Research (2017) 27(1):154-157.
Muller et al., "Spliceosomal peptide P140 for immunotherapy of systemic lupus erythematosus: results of an early phase II clinical

(56) References Cited

OTHER PUBLICATIONS trial," Arthritis & Rheumatism: Official Journal of the American College of Rheumatology, 2008, 58(12); 3873-3883.
Munoz et al., "Epidemiologic classification of human papillomavirus types associated with cervical cancer," N Engl J Med. (2003) 348(6):518-27.
Provasi et al., "Editing T cell specificity towards leukemia by zinc finger nucleases and lentiviral gene transfer," Nat Med. (2012) 18(5):807-815.
Robert-Richard et al., "Murine Retroviral but not Human Cellular Promoters Induce In Vivo Erythroid-specific Deregulation that can be Partially Prevented by Insulators," Mol Ther. (2007) 15(1):173-82.
Roitt et al., Immunology, Moscow, Mir, 2000, pp. 4-6 [in Russian; English excerpt provided].
Roth et al., "Reprogramming human T cell function and specificity with non-viral genome targeting," Nature (2018) 559:405-409.
Russian Office Action for RU 2020115148, dated Jul. 4, 2022, 9 pages [An English translation is provided].
Sadelain et a., "Targeting CARs to the TRAC locus enhances T-cell potency," Clin Cancer Res Dec. 15, 2017 (23) (24 Supplement) Abstract IA22.
Singer et al., Genes and Genomes, Moscow, Mir, 1998, vol. 1, pp. 63-64 [In Russian; English excerpt provided].
Yacoubian, T.A. "Neurodegenerative Disorders: Why Do We Need New Therapies?" Chapter 1. In: Drug Discovery Approaches for the Treatment of Neurodegenerative Disorders.Alzheimer's Disease (Ed. Adeboye Adejare). Academic Press. 2017. pp. 1-16, see abstract.
Schumann et al., "Generation of knock-in primary human T cells using Cas9 ribonucleoproteins," Proc Natl Acad Sci USA. (2015) 112(33):10437-42.

\* cited by examiner

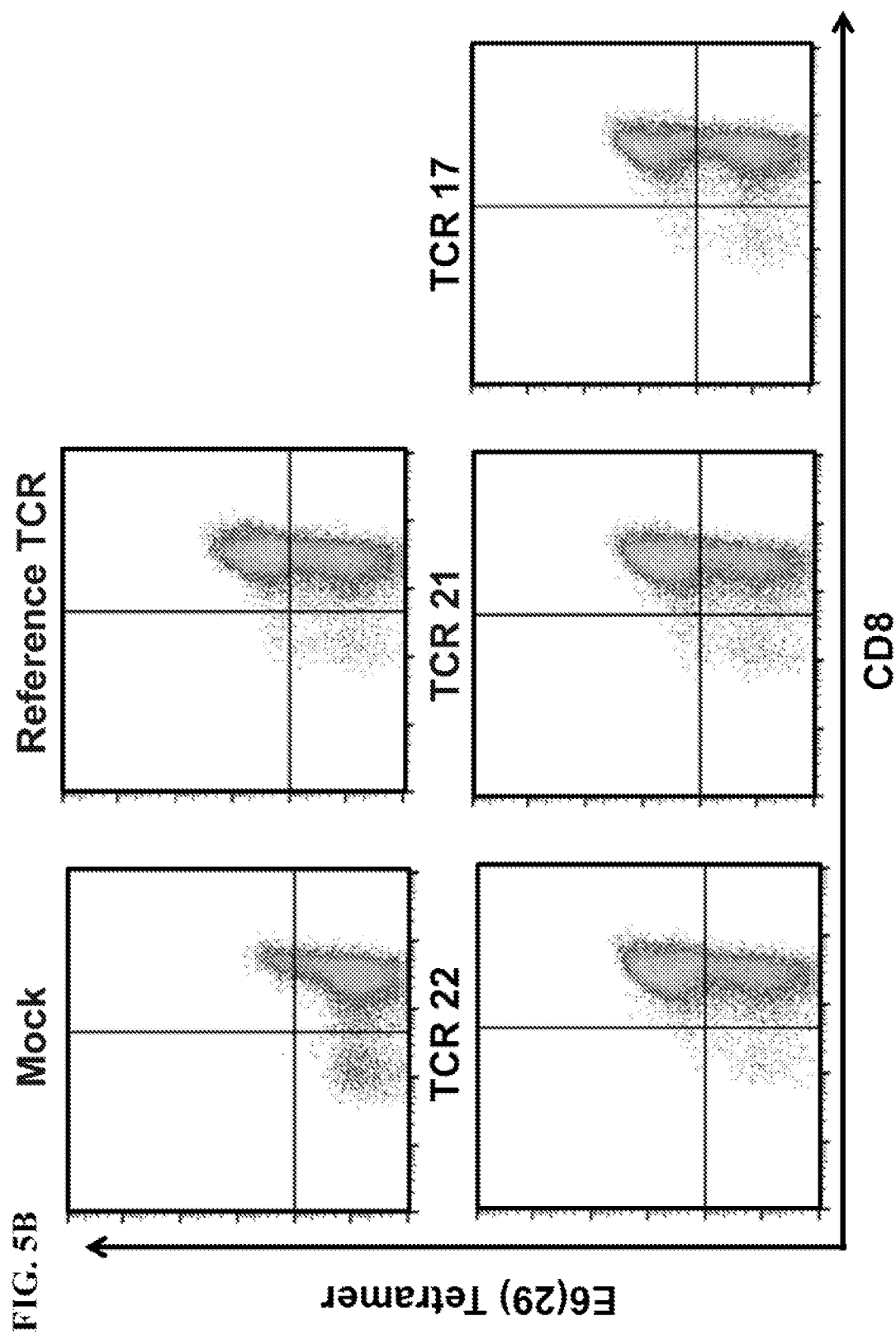

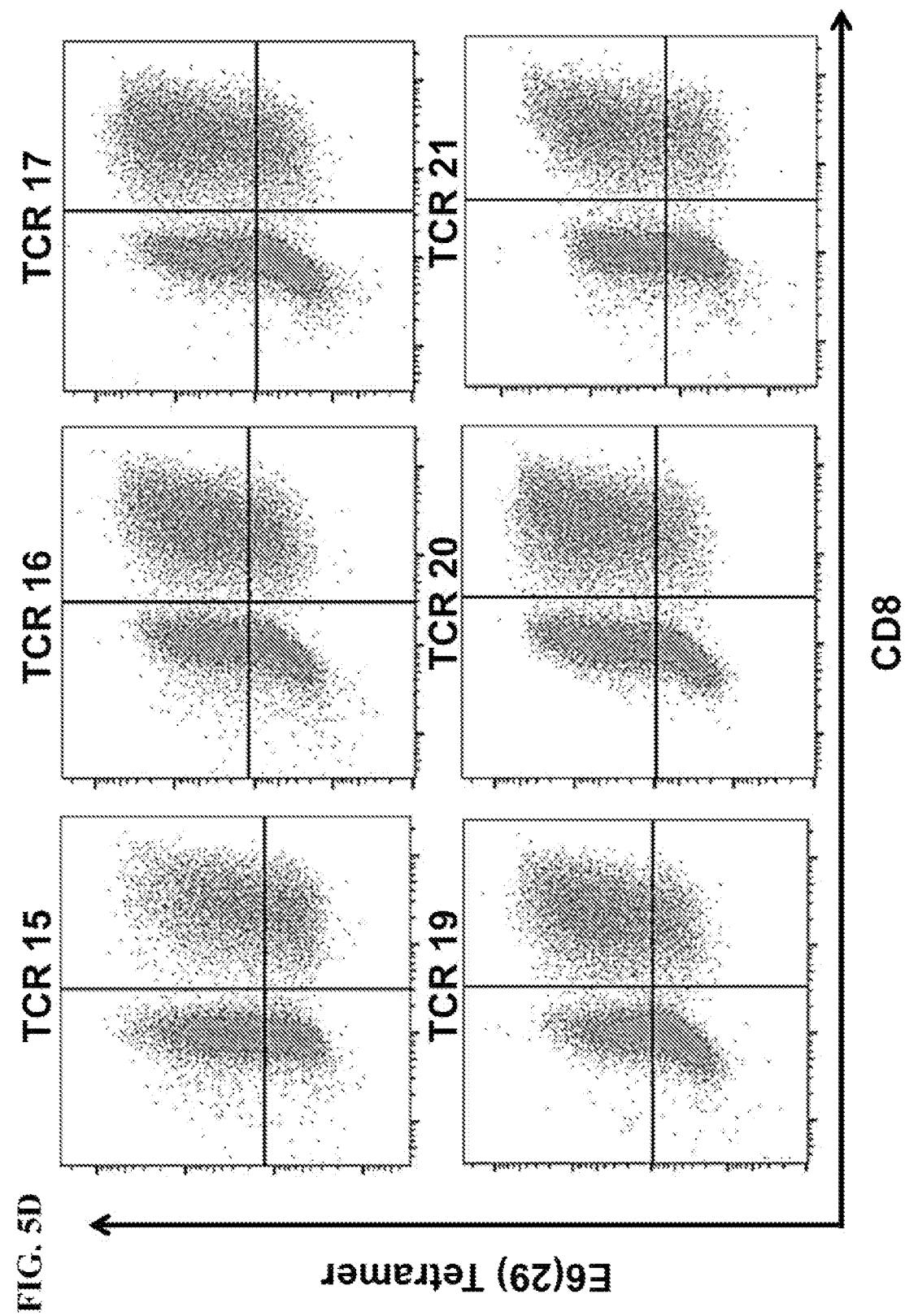

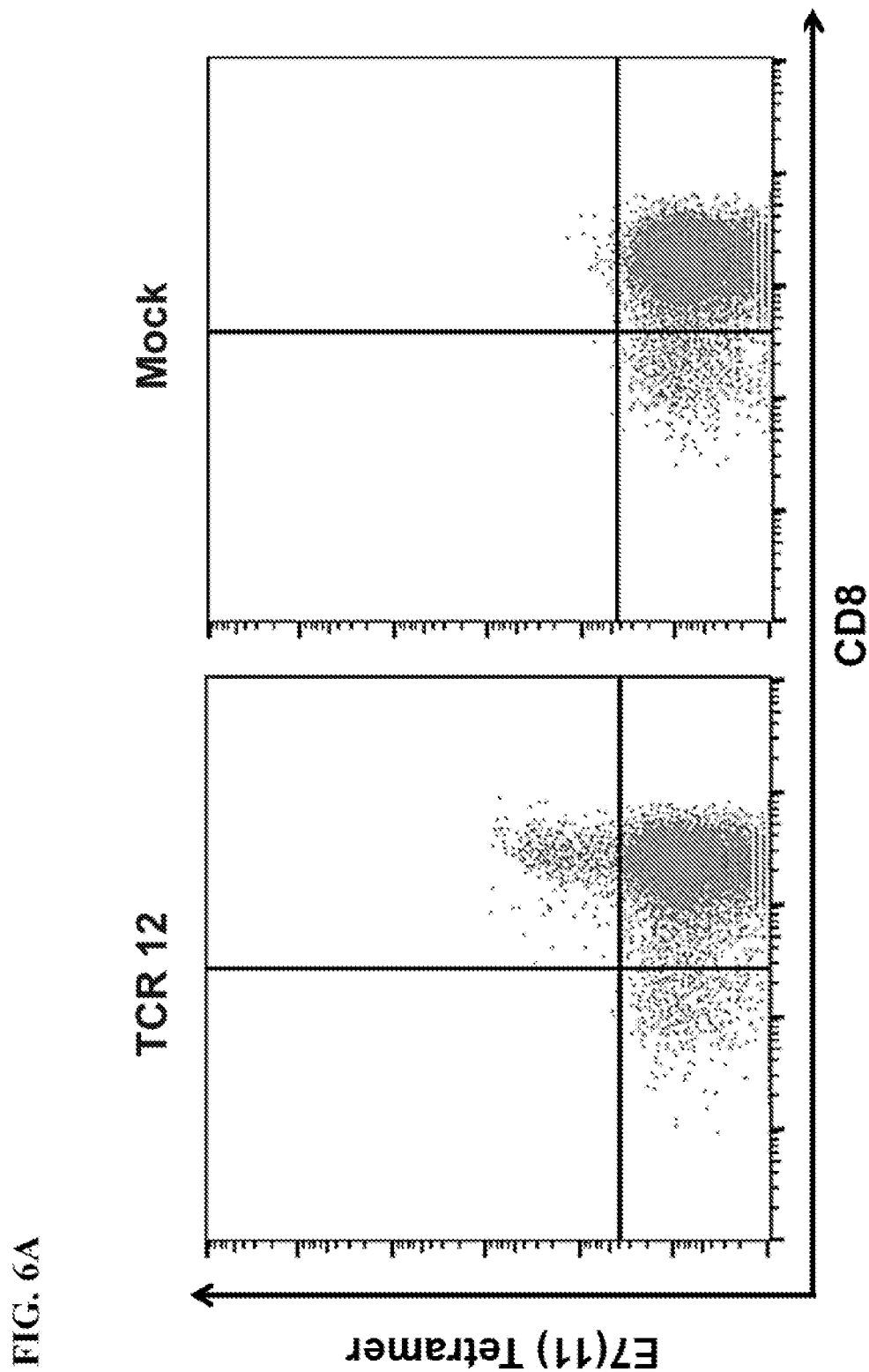

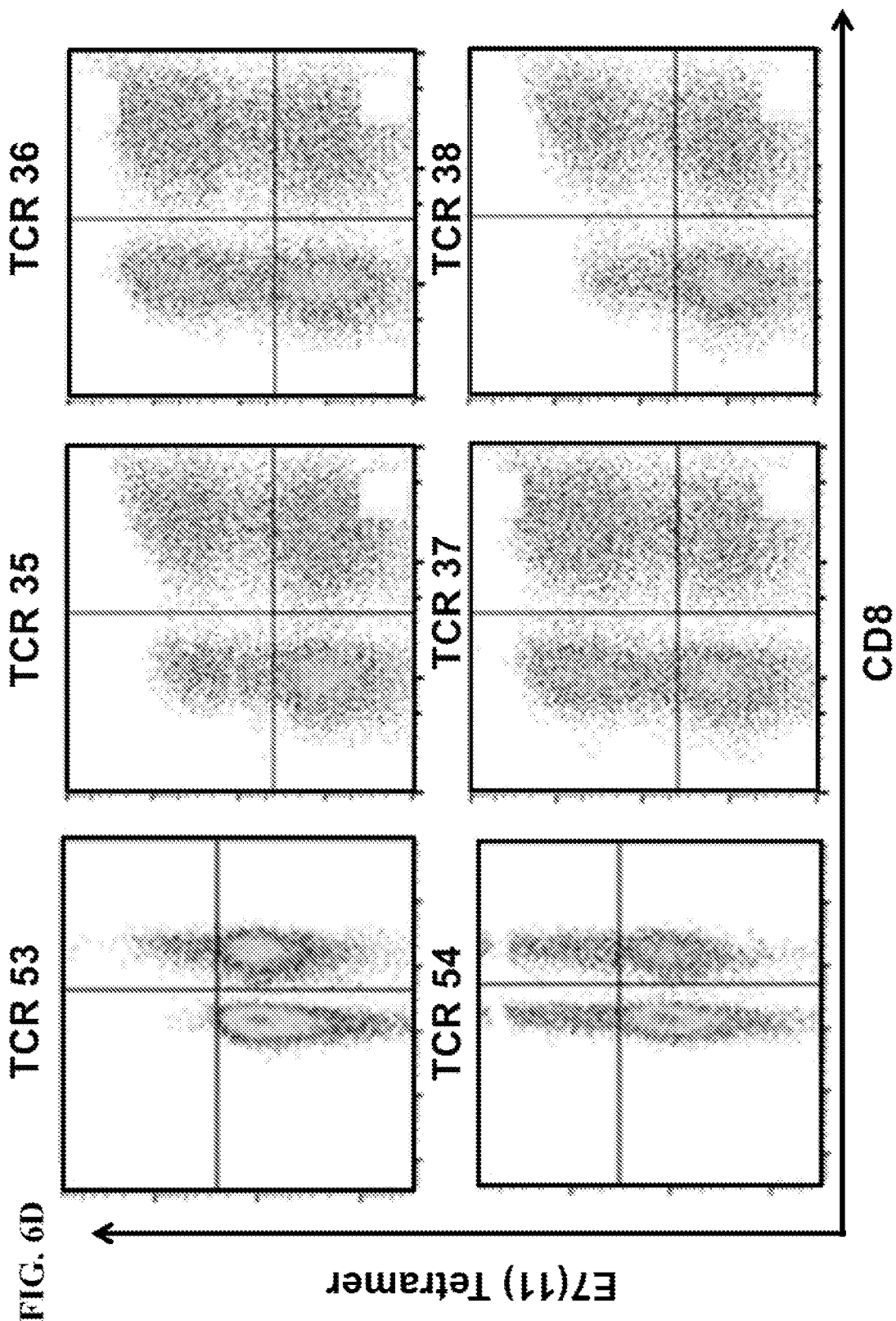

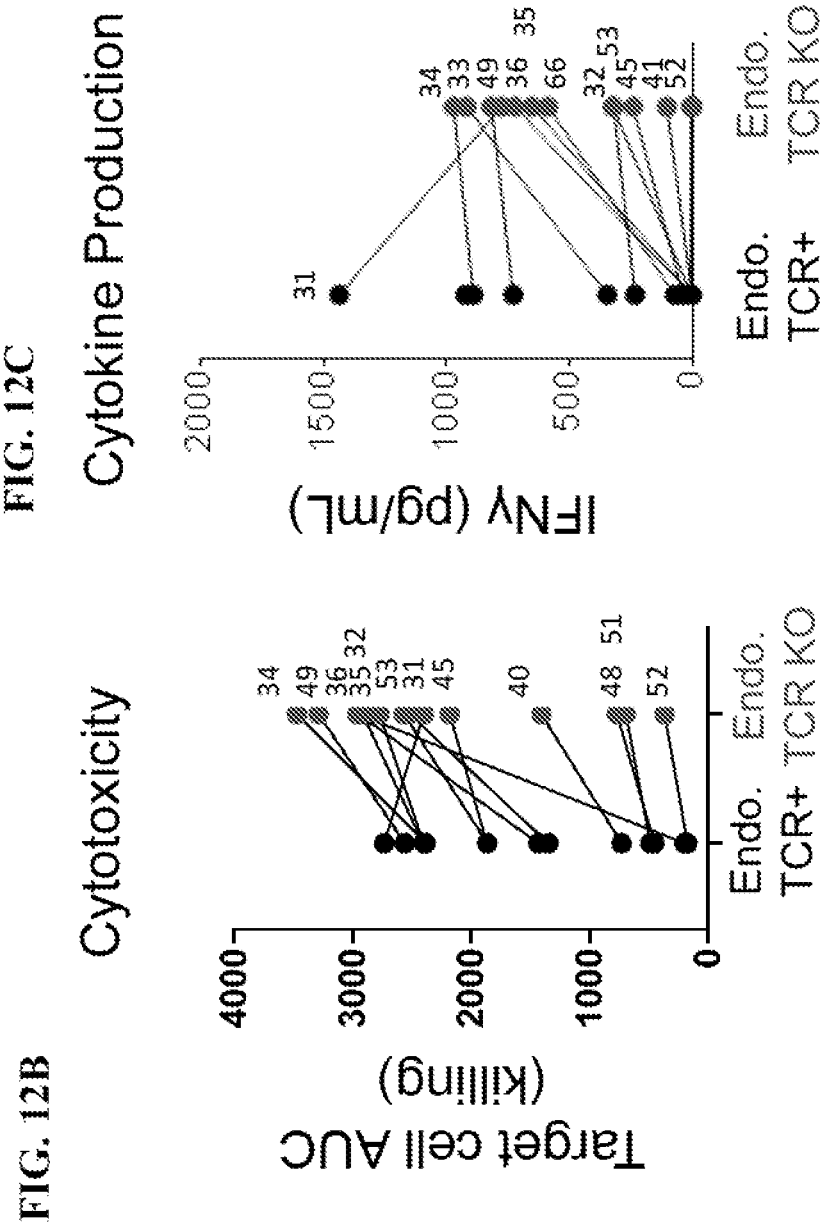

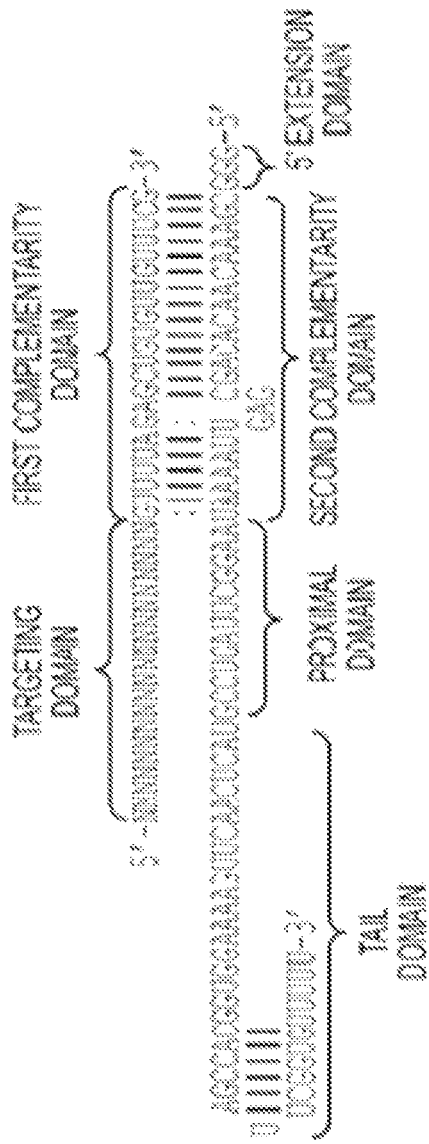

SEQUENCE ALIGNMENT BETWEEN SpCas9 AND NmCas9

```
                      Y
NmCas9    MAAFKPNSINYILGLDIGIASVGWAMVEIDEEENPIRLID--------------LGVRVFE
SpCas9    ------MDKKYSIGLDIGTNSVGWAVITDEYKVPSKKFKVLGNTDRHSIKKNLIGALLFD
          ----------*Y-*GLDIG--SVGWA**--*--*-----**-------------*G--*F*

NmCas9    RAEVPKTGDSLAMARRLARSVRRLTRRRAHRLLRTRRLLKREGVLQAA-------------
SpCas9    SGET-------AEATRLKRTARRRYTRRKNRICYLQEIFSNEMAKVDDSFFHRLEESFLV
          --E---------A-A-RL-R*-RR---RR--R*---*-**--E-----------------

NmCas9    ---------------NFDENGLIKSLPNTPWQLRAAALDRK---LTPLEWSAVLLHLIKHR
SpCas9    EEDKKHERHPIFGNIVDEVAYHEKYP-TIYHLRKKLVDSTDKADLRLI-YLALAHMIKFR
          ----------------DE----*---P-T **LR---*D---------L-----L-H*IK-R

NmCas9    GYLSQRKNE--------------------------------GETA---------DKEL---
SpCas9    GHFLIEGDLNPDNSDVDKLFIQLVQTYNQLFEENPINASGVDAKAILSARLSKSRRLENL
          G**-----*------------------------G--A------------*-L---

NmCas9    -----GALLKGVAGNAHALQTG---DFRTPAE------LAL--NKFEKESGHIRNQ-RSD
SpCas9    IAQLPGEKKNGLFGNLIALSLGLTPNFKSNFDLAEDAKLQLSKDTYDDDLDNLLAQIGDQ
          ------G----*G*-GN--AL--G----*F**---*-------L-L--*-*-*----Q----*

NmCas9    YSHTFSR------------------------------------------------KDLQA
SpCas9    YADLFLAAKNLSDAILLSDILRVNTEITKAPLSASMIKRYDEHHQDLTLLKALVRQQLPE
          Y*--F-------------------------------------------------**L--

NmCas9    ELILLFEKQKEFGN-PHVSGGLK----------------EGIETL---------LMTQRPA
SpCas9    KYKEIFFDQSKNGYAGYIDGGASQEEFYKFIKPILEKMDGTEELLVKLNREDLLRKQRTF
          *----*F--Q-*-G---**-GG----------------*G-E-L---------L--QR--

NmCas9    LSGDAV-QKMLGH--------CTFEPAEP-----------KAAKNTYTAERFIWL
SpCas9    DNGSIPHQIHLGELHAILRRQEDFYPFLKDNREKIEKILTFRIPYYVGPLARGNSRFAWM
          --G----Q--LG-----------F-P-----------*-----RF-W*

NmCas9    TKLNNLRILEQGSERPLTD--------TERATLMDEPY------RKSKLTYAQAR------
SpCas9    TRKSEETITPWNFEEVVDKGASAQSFIERMTNFDKNLPNEKVLPKHSLLYEYFTVYNELT
          T*--**--I-----E--*----------ER-T-*D*--------K--L-Y----------

NmCas9    ----KLLGLEDTAFFKGLRY---------GKDN--------------------------AEA
SpCas9    KVKYVTEGMRKPAFLSGEQKKAIVDLLFKTNRKVTVKQLKEDYFKKIECFDSVEISGVED
          ----------G*----AF*-G-*-----*-----------------------------E-

NmCas9    STLMEMKAYHAISRALEKEGLKDKKSPLNLSPELQDEIGTAFSLFKTDEDITGRLKDRIQ
SpCas9    RFNASLGTYHDLLKIIKDKDFLDNEE----NEDILEDIVLTLTLFEDREMIEERLKTYAH
          -------*-*YH-*-*-**-*-*-*-D**--------**-**I---***LF*--E-I--RLK---*

NmCas9    P--EILEALLKHISFDKFVQISLKALRRIVPLMEQGKRYDEACAE----IYGDHYGKKNT
SpCas9    LFDDKVMKQLKRRRYTGWGRLSRKLI---------NGIRDKQSGKTILDFLKSDGFANRNF
          ----*-*----LK---*--*-**-S-K-*-------*G-R--**---------*--D-*-**N-
```

FIG. 16B

```
NmCas9    EEKI-------Y-------------------LPPIPADEIRNPVVLRALSQASKVINGVVRRYG-
SpCas9    HQLIHDDSLTFKEDIQKAQVSGQGDSLHEHIANLAGSPAIKKGILQTVKVVDELVKVMGR
          -*-I--------*-----------------L---A*----P-*-*-*-Q*-KV**-*V*--G-
                 B
NmCas9    -SPAIHIETAREIGKSFKDRKEIEKRQEENRKDREKAAAKFREYFPNP----VGEPKSK
SpCas9    HKPENIVIEMAREIQTTQKGQNSRER-------NKRIEEGIKELGSQILKEHPVENTQL
          ---P--L-IE-ARE---*-K--*K*---*R---------**------**-E----*E------
                                                  G
NmCas9    DILKLRLYEQQHGKCLYSGKEINLGRLNEKGYEIDHALPFSRTWDDSFNNKVLVLGSEN
SpCas9    QNEKLYLYYLQNGRDMYVDQELDINRLSD----IVDHIVPQSFLKDDSIDNKVLTRSDKN
          *--KL-LY--Q-Q-*-Y--*-E*** RL-*----**DH-*-P-S---DDS**NKVL-----*N

NmCas9    QNKGNQTPYEYFNGKDNSREWQEFKA-NVET-SRFP-RSKKQRILLQKFDEDGFKERNLN
SpCas9    RGKSDNVPSEEVVKKM-KNYWRQLLNAKLITQRKFDNLTKAERGGLSELDKAGFIKRQLV
          * K-**-P-E----K-----W*------**-T---F---*K-*R--L-**D*-GF-*R*L-
```

FIG. 16C

```
NmCas9  DTRYVHRFLCQFVADRMRLTGKGKKRVF------ASNGQITNLLRGTWGLRKVRAENDR
SpCas9  ETRQITKHVAQILDSRMNTKYDENDKLIREVKVITLKSKLVSDFRKDFQFYKVREINNY
        *TR-*-*--Q**---RM-----------*-***----*-*-***----R--*-*--KVR--N*-

NmCas9  HALDAVVACSTVAMQQKI----TRFVRYKEMNAFDKTID----NETGEVLHQKTHFPQP
SpCas9  HAHDAYLNAVVGTALIKKYPKLESEFVYGDYKVYDVRKMIAKSEQEIGKATAKYFFYSNI
        H*-AD-*-A-------R*--K-----Y-----*--D------*----*G-G*----*--

NmCas9  MEFPAQEVMIRVFGKPDGKPE----------FEEADTLEKLRTLLAEKLSSRPEAVHEY
SpCas9  MNFFKTEITLA-NGEIRKRPLIETNGETGEIVWDKGRDFATVRKVLS----MRQ------
        -*FF--E-*--*--G*----*P-----***-*---*----R--*L--------P*-----

NmCas9  VTPLFVSRAPHRKMSGQGHRETVKSARLDEGVSVLRVPLTQLKLKDLERMVN--RERER
SpCas9  ------------VNIVKKTEVQTGGFSKES----ILPKRNSDKLIARKKDWDP
        ------------**-VK-*-----G--S---------L---**-*K-**----**--P

NmCas9  KLYEAIKARLEAHKDDPAKAFAEPFYKYDKAGNRTQQVKAVR---VEQVQKTGVWVRNH-
SpCas9  KEYGGFD---------SPTVAYSVLVVAKVEKGK-SKKLKSVKELLGITIMERSSFEKNPI
        K-Y-----------P-A**----*--G*-----*****K*V--------*-----------

NmCas9  -----NGIAD----------HATMVRVDVFEKGDKYYLVPIY--------
SpCas9  DFLEAKGYKEVKKDLIIKLPKYSLFELENGRKRMLASAGELQKGNELALPSKYVNFLYLA
        ----*--G---*-------------*KG**--L--Y----------

NmCas9  -SMQVAKGILPDRAVVQGKDEEDWQLIDDS-------FNFKFSLHPNDLVEVI---------
SpCas9  SHYEKLKGSPEDNEQKQLFVEQHKHYLDEIIEQISEFSKRVTLADANLDKVLSAYNKHRD
        --**--KG---D----Q---E*--*-D*------F---L---*L--*V*-----

NmCas9  ------------TKKARMFGYFASCHRGTGNINIRIHDLDHKIGRNGILEGIGV
SpCas9  KPIREQAENIIHLFTLTNLGAPAAFKYFDTTIDRKRYTS-TKEVLDATLIHQSI---------
        -------------F-YF-*----------*--------ID--*--**--I---------

NmCas9  KTALSFQKYQIDELGKEIRPCRLKKRPPVR   (SEQ ID NO: 6)
SpCas9  -TGLYETRIDLSQLGGD-----------      (SEQ ID NO: 7)
        -T-L------*-*----LG-*-----
```

PERCENT IDENTITY MATRIX - CREATED BY CLUSTAL2.1

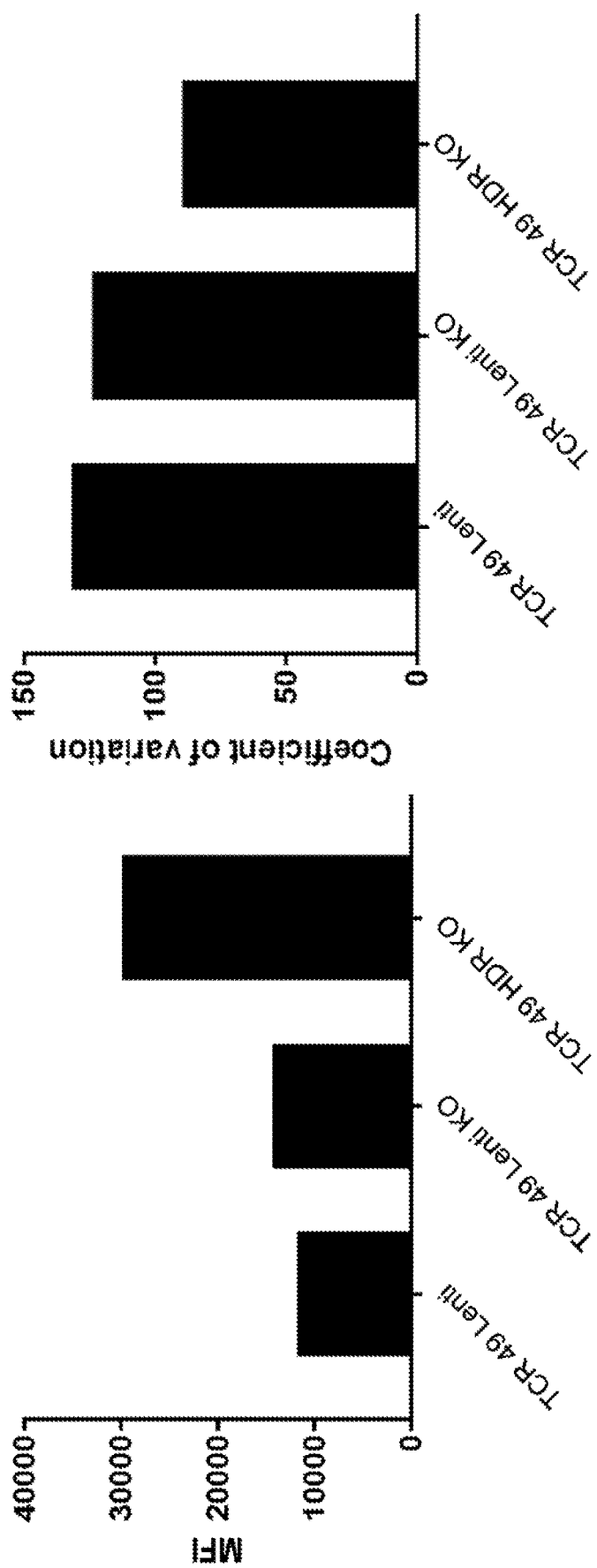

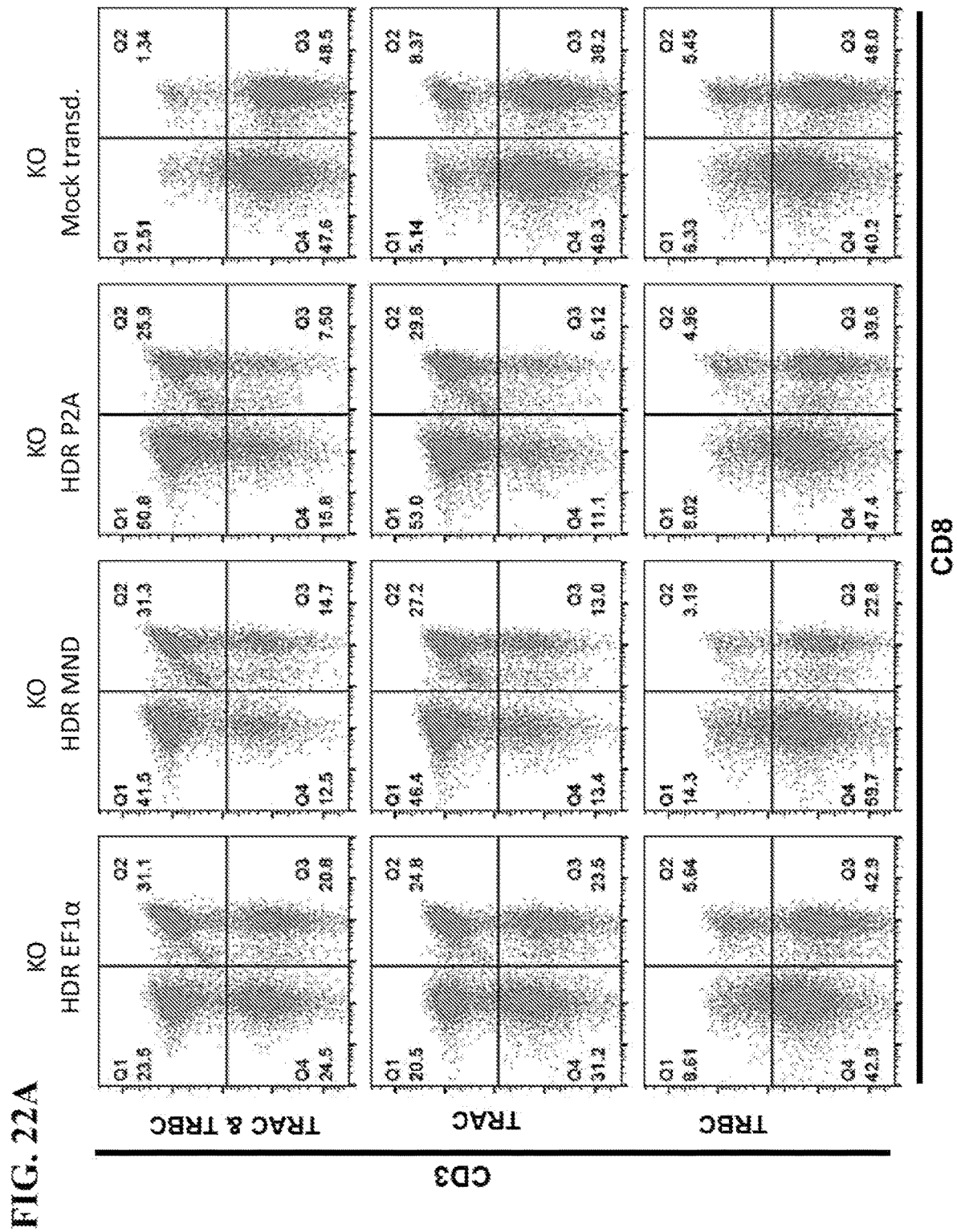

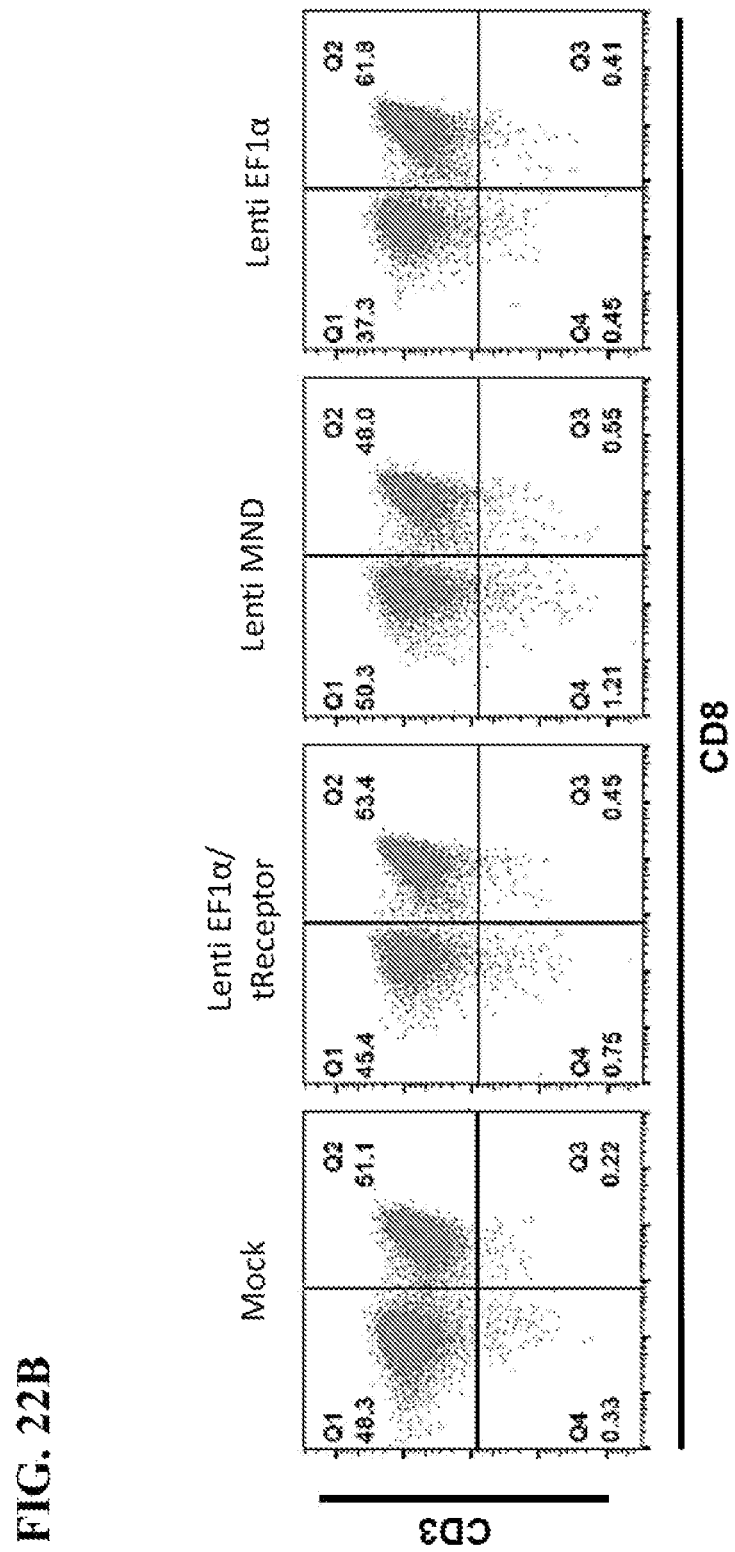

HPV-SPECIFIC BINDING MOLECULES

CROSS-REFERENCE TO RELATED APPLICATIONS

This application is a National Stage application under 35 U.S.C. § 371 of International Application No. PCT/US2018/053650, filed on Sep. 28, 2018 which claims priority from U.S. provisional patent application 62/567,750, filed Oct. 3, 2017, entitled "HPV-SPECIFIC BINDING MOLECULES," U.S. provisional patent application 62/597,411, filed Dec. 11, 2017, entitled "HPV-SPECIFIC BINDING MOLECULES," and U.S. provisional patent application 62/653,529, filed Apr. 5, 2018, entitled "HPV-SPECIFIC BINDING MOLECULES", the contents of which are incorporated by reference in their entirety.

INCORPORATION BY REFERENCE OF SEQUENCE LISTING

The present application is being filed along with a Sequence Listing in electronic format. The Sequence Listing is provided as a file entitled 735042014100SeqList.txt, created May 17, 2021, which is 2,288,800 bytes in size. The information in the electronic format of the Sequence Listing is incorporated by reference in its entirety.

FIELD

The present disclosure relates in some aspects to binding molecules, such as those that recognize or bind a peptide epitope of human papilloma virus (HPV) 16 E6 or E7 in the context of a major histocompatibility complex (MHC) molecule. In particular, the present disclosure relates to T cell receptors (TCRs) or antibodies, including antigen-binding fragments thereof, that bind or recognize a peptide epitope of HPV 16 E6 or E7. The present disclosure further relates to engineered cells comprising such binding molecules, e.g., TCRs or antibodies (and chimeric antigen receptors containing the antibodies), and uses thereof in adoptive cell therapy.

BACKGROUND

Human papillomavirus (HPV) is a common virus among human subjects that, in some cases, can be transmitted by skin-to-skin contact and is a common sexually transmitted virus. Certain subtypes of HPV, such as HPV 16, can lead to certain cancers, such as cervical and other cancers. In some cases, cancer can be associated with expression of the HPV oncoproteins E6 and/or E7. For example, HPV E6 and/or E7 may contribute to cancer progression by targeting tumor suppressor signaling pathways that are involved in cellular growth control. Certain therapeutic agents targeting HPV 16-expressing cells or cancers are available, but improved agents against HPV 16 are needed. Provided are embodiments that meet such needs.

SUMMARY

Provided herein are T cell receptors (TCRs) or antigen-binding fragment thereof. In some embodiments, the TCR contains an alpha chain containing a variable alpha (Vα) region and a beta chain containing a variable beta (Vβ) region, wherein: the Vα region contains the amino acid sequence set forth in any of SEQ ID NOs: 691, 709, 726, 741, 759, 775, 787, 799, 815, 830, 845, 857, 869, 881, 895, 908, 925, 937, 951, 963, 975, 987, 999, or 1390, or an amino acid sequence that has at least 90%, 91%, 92%, 93%, 94%, 95%, 96%, 97%, 98%, or 99% sequence identity thereto; and/or the Vβ region contains the amino acid sequence set forth in any of SEQ ID NOs: 700, 718, 735, 750, 768, 781, 793, 808, 824, 839, 851, 863, 875, 887, 901, 917, 931, 945, 957, 969, 981, 993, 1008, or 1380, or an amino acid sequence that has at least 90%, 91%, 92%, 93%, 94%, 95%, 96%, 97%, 98%, or 99% sequence identity thereto.

In some embodiments, the Vα region contains a complementarity determining region 3 (CDR-3) containing the amino acid sequence $AX_2X_3X_4X_5X_6X_7X_8X_9X_{10}X_{11}X_{12}X_{13}X_{14}$ (SEQ ID NO:1185), wherein $X_2$ is A, G, V, Q, M, or E; $X_3$ is S, G, N, A, Y, R, or P; $X_4$ is E, S, A, G, F, N, D, V, P, L, I, M, or R; $X_5$ is R, N, H, T, D, G, S, P, L, Q, or F; $X_6$ is G, H, A, S, T, or null; $X_7$ is T, S, G, or null; $X_8$ is G, or null; $X_9$ is G, N, S, or null; $X_{10}$ is T, G, S, D, F, Y, A, or N; $X_{11}$ is Y, F, Q, R, or N; $X_{12}$ is K, Q, or D; $X_{13}$ is Y, L, T, M, F, or V; $X_{14}$ is I, T, S, R, Y, or V; the Vα region contains a complementarity determining region 3 (CDR-3) containing the amino acid sequence $X_1X_2X_3X_4X_5X_6X_7X_8X_9X_{10}KX_{12}I$ (SEQ ID NO:1186), wherein $X_1$ is A, or V; $X_2$ is A, V, or E; $X_3$ is S, N, T, R, or P; $X_4$ is E, A, G, F, V, P, I, D, or S; $X_5$ is R, H, T, A P, S, G, or F; $X_6$ is G, H, L, T, S, or A, null; $X_7$ is S, T, or null; $X_8$ is G, or null; $X_9$ is G, T, or null; $X_{11}$, is F, Y, or N; $X_{12}$ is Y, T, or L; the Vα region contains a complementarity determining region 3 (CDR-3) containing the amino acid sequence $AX_2X_3X_4X_5X_6X_7X_8X_9YKYI$ (SEQ ID NO:1187), wherein $X_2$ is A, V, or E; $X_3$ is S, N, or R; $X_4$ is E, G, V, P, I, or D; $X_5$ is R, T, P, S, G, or F; $X_6$ is G, T, S, or null; $X_7$ is S, or null; $X_8$ is G, or null; $X_9$ is T, or null; the Vα region contains a complementarity determining region 3 (CDR-3) containing the amino acid sequence $AX_2X_3X_4X_5X_6X_7X_8X_9X_{10}X_{11}X_{12}X_{13}X_{14}$. (SEQ ID NO:1188), wherein $X_2$ is G, V, Q, or M; $X_3$ is G, A, Y, S, N, or R; $X_4$ is S, G, L, I, M, or R; $X_5$ is N, D, G, S, L, Q, or R; $X_6$ is A, S, G, or null; $X_7$ is G, or null; $X_8$ is G, or null; $X_9$ is G, N, S, or null; $X_{10}$ is S, D, Y, A, N, or null; $X_{11}$ is Y, Q, or R; $X_{12}$ is K, or Q; $X_{13}$ is L, or V;)(N is S, T, or V; the Vα region contains a complementarity determining region 3 (CDR-3) containing the amino acid sequence $AX_2X_3X_4X_5X_6X_7X_8X_9X_{10}X_{11}X_{12}X_{13}T$ (SEQ ID NO: 1189), wherein $X_2$ is G, V, or Q; $X_3$ is G, Y, S, or N; $X_4$ is S, L, or M; $X_5$ is N, G, L, or R; $X_6$ is A, S, G, or null; $X_7$ is G, or null; $X_8$ is G, or null; $X_9$ is G, S, or null; $X_{10}$ is S, Y, A, N, or null; $X_{11}$ is Y, Q, or R; $X_{12}$ is K, or Q; $X_{13}$ is L, or V; the Vα region contains a complementarity determining region 3 (CDR-3) containing the amino acid sequence $AX_2X_3X_4X_5X_6X_7YKLS$ (SEQ ID NO:1190), wherein $X_2$ is G, or V; $X_3$ is A, or Y; $X_4$ is G, S, or R; $X_5$ is D, or S; $X_6$ is N, or null; $X_7$ is D, or null.

In some embodiments, the Vβ region contains a complementarity determining region 3 (CDR-3) containing the amino acid sequence $AX_2X_3X_4X_5X_6X_7X_8X_9X_{10}X_{11}X_{12}X_{13}X_{14}$ (SEQ ID NO:1200), $X_2$ is S, V, or I; $X_3$ is S, N, or A; $X_4$ is R, V, S, L, P, G, I, or A; $X_5$ is F, G, Y, L, V, R, T, or S; $X_6$ is L, G, A, D, R, V, or null; $X_7$ is G, D, R, S, T, or null; $X_8$ is S, or null; $X_9$ is S, H, G, V, T, D, L, or null; $X_{11}$) is T, S, A, G, P, N, or Y; $X_{11}$ is D, Y, E, G, or N; $X_{12}$ is T, E, G, or K; $X_{13}$ is Q, Y, or L; $X_{14}$ is Y, F, T, or I; the Vβ region contains a complementarity determining region 3 (CDR-3) containing the amino acid sequence $ASSX_4X_5X_6X_7X_8X_9X_{10}X_{11}X_{12}X_{13}X_{14}$ (SEQ ID NO:1201), wherein $X_4$ is R, V, S, L, G, or A; $X_5$ is F, G, Y, L, V, T, or S; $X_6$ is A, L, R, D, G, or null; $X_7$ is G, D, T, or null; $X_8$ is S, or null; $X_9$ is S, H, G, T, D, L, or null; $X_{11}$) is T, S, A, G, P, N, or Y; $X_{11}$ is D, Y, E, G, or N; $X_{12}$ is T, E, or G; $X_{13}$ is Q, Y, or L; $X_{14}$ is Y, F, or T; the Vβ region contains a complementarity determining region 3 (CDR-3) containing the amino acid sequence ASSX$_4$X$_5$X$_6$X$_7$X$_8$X$_9$X$_{10}$TQY (SEQ ID NO: 1202), wherein $X_4$ is R, L, or G; $X_5$ is F, V, T, or Y; $X_6$ is L, or A, null; $X_7$ is G, or null; $X_8$ is S, G, or null; $X_9$ is T, G, P, or S; $X_{10}$ is D, or E.

Provided herein are T cell receptors (TCRs) or antigen-binding fragment thereof, containing an alpha chain containing a variable alpha (Vα) region and a beta chain containing a variable beta (Vβ) region, wherein: the Vα region contains a complementarity determining region 3 (CDR-3) containing the amino acid sequence AX$_2$X$_3$X$_4$X$_5$X$_6$X$_7$X$_8$X$_9$X$_{10}$X$_{11}$X$_{12}$X$_{13}$X$_{14}$ (SEQ ID NO:1185), wherein $X_2$ is A, G, V, Q, M, or E; $X_3$ is S, G, N, A, Y, R, or P; $X_4$ is E, S, A, G, F, N, D, V, P, L, I, M, or R; $X_5$ is R, N, H, T, D, G, S, P, L, Q, or F; $X_6$ is G, H, A, S, T, or null; $X_7$ is T, S, G, or null; $X_8$ is G, or null; $X_9$ is G, N, S, or null; $X_{11}$) is T, G, S, D, F, Y, A, or N; $X_{11}$ is Y, F, Q, R, or N; $X_{12}$ is K, Q, or D; $X_{13}$ is Y, L, T, M, F, or V; $X_{14}$ is I, T, S, R, Y, or V; the Vα region contains a complementarity determining region 3 (CDR-3) containing the amino acid sequence X$_1$X$_2$X$_3$X$_4$X$_5$X$_6$X$_7$X$_8$X$_9$X$_{10}$KX$_{12}$I (SEQ ID NO:1186), wherein $X_1$ is A, or V; $X_2$ is A, V, or E; $X_3$ is S, N, T, R, or P; $X_4$ is E, A, G, F, V, P, I, D, or S; $X_5$ is R, H, T, A P, S, G, or F; $X_6$ is G, H, L, T, S, or A, null; $X_7$ is S, T, or null; $X_8$ is G, or null; $X_9$ is G, T, or null; $X_{11}$) is F, Y, or N; $X_{12}$ is Y, T, or L; the Vα region contains a complementarity determining region 3 (CDR-3) containing the amino acid sequence AX$_2$X$_3$X$_4$X$_5$X$_6$X$_7$X$_8$X$_9$YKYI (SEQ ID NO:1187), wherein $X_2$ is A, V, or E; $X_3$ is S, N, or R; $X_4$ is E, G, V, P, I, or D; $X_5$ is R, T, P, S, G, or F; $X_6$ is G, T, S, or null; $X_7$ is S, or null; $X_8$ is G, or null; $X_9$ is T, or null; the Vα region contains a complementarity determining region 3 (CDR-3) containing the amino acid sequence AX$_2$X$_3$X$_4$X$_5$X$_6$X$_7$X$_8$X$_9$X$_{10}$X$_{11}$X$_{12}$X$_{13}$X$_{14}$ (SEQ ID NO:1188), wherein $X_2$ is G, V, Q, or M; $X_3$ is G, A, Y, S, N, or R; $X_4$ is S, G, L, I, M, or R; $X_5$ is N, D, G, S, L, Q, or R; $X_6$ is A, S, G, or null; $X_7$ is G, or null; $X_8$ is G, or null; $X_9$ is G, N, S, or null; $X_{11}$) is S, D, Y, A, N, or null; $X_{11}$ is Y, Q, or R; $X_{12}$ is K, or Q; $X_{13}$ is L, or V; $X_{14}$ is S, T, or V; the Vα region contains a complementarity determining region 3 (CDR-3) containing the amino acid sequence AX$_2$X$_3$X$_4$X$_5$X$_6$X$_7$X$_8$X$_9$X$_{10}$X$_{11}$X$_{12}$X$_{13}$T (SEQ ID NO: 1189), wherein $X_2$ is G, V, or Q; $X_3$ is G, Y, S, or N; $X_4$ is S, L, or M; $X_5$ is N, G, L, or R; $X_6$ is A, S, G, or null; $X_7$ is G, or null; $X_8$ is G, or null; $X_9$ is G, S, or null; $X_{10}$ is S, Y, A, N, or null; $X_{11}$ is Y, Q, or R; $X_{12}$ is K, or Q; $X_{13}$ is L, or V; the Vα region contains a complementarity determining region 3 (CDR-3) containing the amino acid sequence AX$_2$X$_3$X$_4$X$_5$X$_6$X$_7$YKLS (SEQ ID NO:1190), wherein $X_2$ is G, or V; $X_3$ is A, or Y; $X_4$ is G, S, or R; $X_5$ is D, or S; $X_6$ is N, or null; $X_7$ is D, or null.

Provided herein are T cell receptors (TCRs) or antigen-binding fragment thereof, containing an alpha chain containing a variable alpha (Vα) region and a beta chain containing a variable beta (Vβ) region, wherein: the Vβ region contains a complementarity determining region 3 (CDR-3) containing the amino acid sequence AX$_2$X$_3$X$_4$X$_5$X$_6$X$_7$X$_8$X$_9$X$_{10}$X$_{11}$X$_{12}$X$_{13}$X$_{14}$ (SEQ ID NO:1200), $X_2$ is S, V, or I; $X_3$ is S, N, or A; $X_4$ is R, V, S, L, P, G, I, or A; $X_5$ is F, G, Y, L, V, R, T, or S; $X_6$ is L, G, A, D, R, V, or null; $X_7$ is G, D, R, S, T, or null; $X_8$ is S, or null; $X_9$ is S, H, G, V, T, D, L, or null; $X_{10}$ is T, S, A, G, P, N, or Y; $X_{11}$ is D, Y, E, G, or N; $X_{12}$ is T, E, or G; $X_{13}$ is Q, Y, or L; $X_{14}$ is Y, F, T, or I; the Vβ region contains a complementarity determining region 3 (CDR-3) containing the amino acid sequence ASSX$_4$X$_5$X$_6$X$_7$X$_8$X$_9$X$_{10}$X$_{11}$X$_{12}$X$_{13}$X$_{14}$ (SEQ ID NO:1201), wherein $X_4$ is R, V, S, L, G, or A; $X_5$ is F, G, Y, L, V, T, or S; $X_6$ is A, L, R, D, G, or null; $X_7$ is G, D, T, or null; $X_8$ is S, or null; $X_9$ is S, H, G, T, D, L, or null; $X_{10}$ is T, S, A, G, P, N, or Y; $X_{11}$ is D, Y, E, G, or N; $X_{12}$ is T, E, or G; $X_{13}$ is Q, Y, or L; $X_{14}$ is Y, F, or T; the Vβ region contains a complementarity determining region 3 (CDR-3) containing the amino acid sequence ASSX$_4$X$_5$X$_6$X$_7$X$_8$X$_9$X$_{10}$TQY (SEQ ID NO: 1202), wherein $X_4$ is R, L, or G; $X_5$ is F, V, T, or Y; $X_6$ is L, or A, null; $X_7$ is G, or null; $X_8$ is S, G, or null; $X_9$ is T, G, P, or S; $X_{10}$ is D, or E.

Provided herein are T cell receptors (TCRs) or antigen-binding fragments thereof, containing an alpha chain containing a variable alpha (Vα) region and a beta chain containing a variable beta (Vβ) region, wherein: the Vα region contains a complementarity determining region 3 (CDR-3) set forth in any of SEQ ID NOs: 694, 712, 729, 744, 762, 776, 788, 802, 818, 832, 846, 858, 870, 882, 896, 911, 926, 940, 952, 964, 976, 988, 1002 or a sequence that exhibits at least 60%, 65%, 70%, 75%, 80%, 85%, 90% or 95% sequence identity thereto; the Vβ region contains a complementarity determining region 3 (CDR-3) set forth in any of SEQ ID NOs: 703, 721, 736, 753, 769, 782, 794, 809, 825, 840, 852, 864, 876, 888, 902, 919, 932, 946, 958, 970, 982, 994, or 1010 or a sequence that exhibits at least 60%, 65%, 70%, 75%, 80%, 85%, 90% or 95% sequence identity thereto.

In some embodiments, the Vα region contains: a complementarity determining region 1 (CDR-1) containing the amino acid sequence X$_1$X$_2$X$_3$X$_4$X$_5$X$_6$ (SEQ ID NO: 1191), wherein $X_1$ is N, S, D, T, or V; $X_2$ is S, V, R, T, or I; $X_3$ is M, F, G, S, N, A, L, V, or P; $X_4$ is F, S, N, A, or null; $X_5$ is D, S, Q, Y, N, V, T, or P; and $X_6$ is Y, S, R, N, G, or T; and/or a complementarity determining region 2 (CDR-2) containing the amino acid sequence X$_1$X$_2$X$_3$X$_4$X$_5$X$_6$X$_7$X$_8$ (SEQ ID NO: 1192), wherein $X_1$ is I, V, L, G, N, T, Y, or M; $X_2$ is S, V, Y, L, P, F, I, or T; $X_3$ is S, Y, K, L, T, or F; $X_4$ is I, G, N, A, S, or null; $X_5$ is S, D, or null; $X_6$ is K, G, N, S, D, T, or E; $X_7$ is D, E, G, A, K, L, or N; and $X_8$ is K, V, D, P, N, T, L, or M.

In some embodiments, the Vβ region contains: a complementarity determining region 1 (CDR-1) containing the amino acid sequence SX$_2$X$_3$X$_4$X$_5$ (SEQ ID NO:1203), wherein $X_2$ is G, or N; $X_3$ is H, or D; $X_4$ is T, L, N, or V; and $X_5$ is A, S, Y, or T; and/or a complementarity determining region 2 (CDR-2) containing the amino acid sequence X$_1$X$_2$X$_3$X$_4$X$_5$X$_6$ (SEQ ID NO:1204), wherein $X_1$ is F, or Y; $X_2$ is Q, Y, or N; $X_3$ is G, N, R, or Y; $X_4$ is N, G, E, or T; $X_5$ is S, E, A, or G; and $X_6$ is A, E, I, or Q.

In some embodiments, the TCR or antigen-binding fragment thereof binds to or recognizes a peptide epitope of human papillomavirus (HPV) 16 E7 in the context of an MHC molecule, the peptide epitope is or comprises E7(11-19) YMLDLQPET (SEQ ID NO:236).

In some embodiments of the TCRs provided herein, the Vα region contains a complementarity determining region 3 (CDR-3) containing the amino acid sequence set forth in any of SEQ ID NOs: 694, 712, 729, 744, 762, 776, 788, 802, 818, 832, 846, 858, 870, 882, 896, 911, 926, 940, 952, 964, 976, 988 or 1002, or a CDR3 contained within the amino acid sequence set forth in any of SEQ ID NOs: 691, 709, 726, 741, 759, 775, 787, 799, 815, 830, 845, 857, 869, 881, 895, 908, 925, 937, 951, 963, 975, 987 or 999; and/or the Vβ region contains a complementarity determining region 3 (CDR-3) containing an amino acid sequence set forth in any of SEQ ID NOs: 703, 721, 736, 753, 769, 782, 794, 809, 825, 840, 852, 864, 876, 888, 902, 919, 932, 946, 958, 970, 982, 994, 1010, or 1381, or a CDR3 contained within the amino acid sequence set forth in any of SEQ ID NOs: 700, 718, 735, 750, 768, 781, 793, 808, 824, 839, 851, 863, 875, 887, 901, 917, 931, 945, 957, 969, 981, 993, 1008, or 1380.

In some embodiments, the Vα region further comprises: a complementarity determining region 1 (CDR-1) containing an amino acid sequence set forth in any of SEQ ID NOs: 692, 710, 727, 742, 760, 171, 800, 816, 570, 909, 938, 151, or 1000; and/or a complementarity determining region 2 (CDR-2) containing an amino acid sequence set forth in any of SEQ ID NOs: 693, 711, 728, 743, 761, 172, 801, 817, 831, 571, 910, 939, 152, or 1001.

In some embodiments, the Vβ region contains: a complementarity determining region 1 (CDR-1) containing the amino acid sequence set forth in any of SEQ ID NOs: 701, 719, 154, 751 or 139; and/or a complementarity determining region 2 (CDR-2) containing the amino acid sequence set forth in any of SEQ ID NOs: 702, 720, 155, 752, 140 or 918.

In some embodiments, the Vα region contains a CDR-1, CDR-2, and CDR-3, containing the amino acid sequences of SEQ ID NOs: 692, 693, and 694, respectively, and the Vβ region contains a CDR-1, CDR-2, and CDR-3, containing the amino acid sequences of SEQ ID NOs: 701, 702 and 703, respectively; the Vα region contains a CDR-1, CDR-2, and CDR-3, containing the amino acid sequences of SEQ ID NOs: 710, 711, and 712, respectively, and the Vβ region contains a CDR-1, CDR-2, and CDR-3, containing the amino acid sequences of SEQ ID NOs: 719, 720 and 721, respectively; the Vα region contains a CDR-1, CDR-2, and CDR-3, containing the amino acid sequences of SEQ ID NOs: 727, 728 and 729, respectively, and the Vβ region contains a CDR-1, CDR-2, and CDR-3, containing the amino acid sequences of SEQ ID NOs: 154, 155 and 736, respectively; the Vα region contains a CDR-1, CDR-2, and CDR-3, containing the amino acid sequences of SEQ ID NOs: 742, 743 and 744, respectively, and the Vβ region contains a CDR-1, CDR-2, and CDR-3, containing the amino acid sequences of SEQ ID NOs: 751, 752 and 753, respectively; the Vα region contains a CDR-1, CDR-2, and CDR-3, containing the amino acid sequences of SEQ ID NOs: 760, 761 and 762, respectively, and the Vβ region contains a CDR-1, CDR-2, and CDR-3, containing the amino acid sequences of SEQ ID NOs: 719, 720 and 769, respectively; the Vα region contains a CDR-1, CDR-2, and CDR-3, containing the amino acid sequences of SEQ ID NOs: 171, 172 and 776, respectively, and the Vβ region contains a CDR-1, CDR-2, and CDR-3, containing the amino acid sequences of SEQ ID NOs: 154, 155 and 782, respectively; the Vα region contains a CDR-1, CDR-2, and CDR-3, containing the amino acid sequences of SEQ ID NOs: 742, 743 and 788, respectively, and the Vβ region contains a CDR-1, CDR-2, and CDR-3, containing the amino acid sequences of SEQ ID NOs: 139, 140 and 794, respectively; the Vα region contains a CDR-1, CDR-2, and CDR-3, containing the amino acid sequences of SEQ ID NOs: 800, 801 and 802, respectively, and the Vβ region contains a CDR-1, CDR-2, and CDR-3, containing the amino acid sequences of SEQ ID NOs: 751, 752 and 809, respectively; the Vα region contains a CDR-1, CDR-2, and CDR-3, containing the amino acid sequences of SEQ ID NOs: 816, 817 and 818, respectively, and the Vβ region contains a CDR-1, CDR-2, and CDR-3, containing the amino acid sequences of SEQ ID NOs: 154, 155 and 825, respectively; the Vα region contains a CDR-1, CDR-2, and CDR-3, containing the amino acid sequences of SEQ ID NOs: 816, 831 and 832, respectively, and the Vβ region contains a CDR-1, CDR-2, and CDR-3, containing the amino acid sequences of SEQ ID NOs: 154, 155 and 840, respectively; the Vα region contains a CDR-1, CDR-2, and CDR-3, containing the amino acid sequences of SEQ ID NOs: 171, 172 and 846, respectively, and the Vβ region contains a CDR-1, CDR-2, and CDR-3, containing the amino acid sequences of SEQ ID NOs: 154, 155 and 852, respectively; the Vα region contains a CDR-1, CDR-2, and CDR-3, containing the amino acid sequences of SEQ ID NOs: 816, 831 and 858, respectively, and the Vβ region contains a CDR-1, CDR-2, and CDR-3, containing the amino acid sequences of SEQ ID NOs: 154, 155 and 864, respectively; the Vα region contains a CDR-1, CDR-2, and CDR-3, containing the amino acid sequences of SEQ ID NOs: 727, 728 and 870, respectively, and the Vβ region contains a CDR-1, CDR-2, and CDR-3, containing the amino acid sequences of SEQ ID NOs: 154, 155 and 876, respectively; the Vα region contains a CDR-1, CDR-2, and CDR-3, containing the amino acid sequences of SEQ ID NOs: 570, 571 and 882, respectively, and the Vβ region contains a CDR-1, CDR-2, and CDR-3, containing the amino acid sequences of SEQ ID NOs: 719, 720 and 888, respectively; the Vα region contains a CDR-1, CDR-2, and CDR-3, containing the amino acid sequences of SEQ ID NOs: 816, 817 and 896, respectively, and the Vβ region contains a CDR-1, CDR-2, and CDR-3, containing the amino acid sequences of SEQ ID NOs: 701, 702 and 902, respectively; the Vα region contains a CDR-1, CDR-2, and CDR-3, containing the amino acid sequences of SEQ ID NOs: 909, 910 and 911, respectively, and the Vβ region contains a CDR-1, CDR-2, and CDR-3, containing the amino acid sequences of SEQ ID NOs: 701, 702 and 919, respectively; the Vα region contains a CDR-1, CDR-2, and CDR-3, containing the amino acid sequences of SEQ ID NOs: 727, 728 and 926, respectively, and the Vβ region contains a CDR-1, CDR-2, and CDR-3, containing the amino acid sequences of SEQ ID NOs: 154, 155 and 932, respectively; the Vα region contains a CDR-1, CDR-2, and CDR-3, containing the amino acid sequences of SEQ ID NOs: 938, 939 and 940, respectively, and the Vβ region contains a CDR-1, CDR-2, and CDR-3, containing the amino acid sequences of SEQ ID NOs: 154, 155 and 946, respectively; the Vα region contains a CDR-1, CDR-2, and CDR-3, containing the amino acid sequences of SEQ ID NOs: 727, 728 and 952, respectively, and the Vβ region contains a CDR-1, CDR-2, and CDR-3, containing the amino acid sequences of SEQ ID NOs: 154, 155 and 958, respectively; the Vα region contains a CDR-1, CDR-2, and CDR-3, containing the amino acid sequences of SEQ ID NOs: 151, 152 and 964, respectively, and the Vβ region contains a CDR-1, CDR-2, and CDR-3, containing the amino acid sequences of SEQ ID NOs: 719, 720 and 970, respectively; the Vα region contains a CDR-1, CDR-2, and CDR-3, containing the amino acid sequences of SEQ ID NOs: 727, 728 and 976, respectively, and the Vβ region contains a CDR-1, CDR-2, and CDR-3, containing the amino acid sequences of SEQ ID NOs: 154, 155 and 982, respectively; the Vα region contains a CDR-1, CDR-2, and CDR-3, containing the amino acid sequences of SEQ ID NOs: 710, 711 and 988, respectively, and the Vβ region contains a CDR-1, CDR-2, and CDR-3, containing the amino acid sequences of SEQ ID NOs: 719, 729 and 994, respectively; the Vα region contains a CDR-1, CDR-2, and CDR-3, containing the amino acid sequences of SEQ ID NOs: 1000, 1001 and 1002, respectively, and the Vβ region contains a CDR-1, CDR-2, and CDR-3, containing the amino acid sequences of SEQ ID NOs: 139, 1009 and 1010, respectively.

In some embodiments, the Vα region contains a complementarity determining region 1 (CDR-1), a CDR-2, and a CDR-3, respectively containing the CDR-1, CDR-2, and CDR-3 amino acid sequences contained within a Vα region amino acid sequence set forth in any of SEQ ID NOs: 691, 709, 726, 741, 759, 775, 787, 799, 815, 830, 845, 857, 869, 881, 895, 908, 925, 937, 951, 963, 975, 987, 999, or 1390; and/or the Vβ region contains a complementarity determining region 1 (CDR-1), a CDR-2, and a CDR-3, respectively containing the CDR-1, CDR-2, and CDR-3 amino acid sequences contained within a Vβ region amino acid sequence set forth in any of SEQ ID NOs: 700, 718, 735, 750, 768, 781, 793, 808, 824, 839, 851, 863, 875, 887, 901, 917, 931, 945, 957, 969, 981, 993, 1008, or 1380.

In some embodiments, the Vα and Vβ regions comprise the amino acid sequences of SEQ ID NOs: 691 and 700, respectively; the Vα and Vβ regions comprise the amino acid sequences of SEQ ID NOs: 709 and 718, respectively; the Vα and Vβ regions comprise the amino acid sequences of SEQ ID NOs:726 and 735, respectively; the Vα and Vβ regions comprise the amino acid sequences of SEQ ID NOs:741 and 750, respectively; the Vα and Vβ regions comprise the amino acid sequences of SEQ ID NOs:759 and 768, respectively; the Vα and Vβ regions comprise the amino acid sequences of SEQ ID NOs:775 and 781, respectively; the Vα and Vβ regions comprise the amino acid sequences of SEQ ID NOs:787 and 793, respectively; the Vα and Vβ regions comprise the amino acid sequences of SEQ ID NOs:799 and 808, respectively; the Vα and Vβ regions comprise the amino acid sequences of SEQ ID NOs:815 and 824, respectively; the Vα and Vβ regions comprise the amino acid sequences of SEQ ID NOs:830 and 839, respectively; the Vα and Vβ regions comprise the amino acid sequences of SEQ ID NOs:845 and 851, respectively; the Vα and Vβ regions comprise the amino acid sequences of SEQ ID NOs:857 and 863, respectively; the Vα and Vβ regions comprise the amino acid sequences of SEQ ID NOs:869 and 875, respectively; the Vα and Vβ regions comprise the amino acid sequences of SEQ ID NOs:881 and 887, respectively; the Vα and Vβ regions comprise the amino acid sequences of SEQ ID NOs:895 and 901, respectively; the Vα and Vβ regions comprise the amino acid sequences of SEQ ID NOs:908 and 917, respectively; the Vα and Vβ regions comprise the amino acid sequences of SEQ ID NOs:925 and 931, respectively; the Vα and Vβ regions comprise the amino acid sequences of SEQ ID NOs:937 and 945, respectively; the Vα and Vβ regions comprise the amino acid sequences of SEQ ID NOs:951 and 957, respectively; the Vα and Vβ regions comprise the amino acid sequences of SEQ ID NOs:963 and 969, respectively; the Vα and Vβ regions comprise the amino acid sequences of SEQ ID NOs:975 and 981, respectively; the Vα and Vβ regions comprise the amino acid sequences of SEQ ID NOs:987 and 993, respectively; the Vα and Vβ regions comprise the amino acid sequences of SEQ ID NOs:999 and 1008, respectively; or the Vα and Vβ regions comprise the amino acid sequences of SEQ ID NOs:1390 and 1380, respectively.

In some embodiments, the alpha chain further comprises an alpha constant (Cα) region and/or the beta chain further comprises a beta constant (Cβ) region.

In some embodiments, the Cα and Cβ regions are mouse constant regions. In some embodiments, the Cα region contains the amino acid sequence set forth in SEQ ID NO: 262, 833, 1012, 1014, 1015, 1017, 1018, 1362, or a sequence of amino acids that has at least 90% sequence identity thereto; and/or the Cβ region contains the amino acid sequence set forth in SEQ ID NO: 263, 1013 or 1016 or a sequence of amino acids that has at least 90% sequence identity thereto.

In some embodiments, the Cα and Cβ regions are human constant regions. In some embodiments, the Cα region contains the amino acid sequence set forth in any of SEQ ID NOs: 212, 213, 215, 217, 218, 220 or 524, or a sequence of amino acids that has at least 90% sequence identity thereto; and/or the Cβ region contains the amino acid sequence set forth in any of SEQ ID NOs: 214, 216, 631 or 889, or a sequence of amino acids that has at least 90% sequence identity thereto.

In some embodiments, a) the alpha chain comprises: the amino acid sequence set forth in any of SEQ ID NOs: 687, 705, 722, 737, 755, 771, 783, 795, 811, 826, 841, 853, 865, 877, 891, 904, 921, 933, 947, 959, 971, 983, 995, 1386, a sequence of amino acids that has at least 90% sequence identity thereto; or the amino acid sequence encoded by the nucleotide sequence set forth in any of SEQ ID NOs: 1049, 1051, 1055, 1057, 1059, 1061, 1063, 1065, 1067, 1069, 1071, 1073, 1075, 1077, 1079, 1081, 1083, 1085, 1087, 1089, 1091, or a nucleotide sequence that has at least 90% sequence identity thereto; and/or the beta chain comprises: the amino acid sequence set forth in any of SEQ ID NOs: 696, 714, 731, 746, 764, 777, 789, 804, 820, 835, 847, 859, 871, 883, 897, 913, 927, 941, 953, 965, 977, 989, 1004, or 1376, a sequence of amino acids that has at least 90% sequence identity thereto; or the amino acid sequence encoded by the nucleotide sequence set forth in SEQ ID NOS: 1050, 1052, 1056, 1058, 1060, 1062, 1064, 1066, 1068, 1070, 1072, 1074, 1076, 1078, 1080, 1082, 1084, 1086, 1088, 1090 or 1092, or a nucleotide sequence that has at least 90% sequence identity thereto.

In some embodiments, the alpha and beta chains comprise the amino acid sequences of SEQ ID NOs: 687 and 696, respectively; the alpha and beta chains comprise the amino acid sequences of SEQ ID NOs: 705 and 714, respectively; the alpha and beta chains comprise the amino acid sequences of SEQ ID NOs: 722 and 731, respectively; the alpha and beta chains comprise the amino acid sequences of SEQ ID NOs: 737 and 746, respectively; the alpha and beta chains comprise the amino acid sequences of SEQ ID NOs: 755 and 764, respectively; the alpha and beta chains comprise the amino acid sequences of SEQ ID NOs: 771 and 777, respectively; the alpha and beta chains comprise the amino acid sequences of SEQ ID NOs: 783 and 789, respectively; the alpha and beta chains comprise the amino acid sequences of SEQ ID NOs: 795 and 804, respectively; the alpha and beta chains comprise the amino acid sequences of SEQ ID NOs: 811 and 820, respectively; the alpha and beta chains comprise the amino acid sequences of SEQ ID NOs: 826 and 835, respectively; the alpha and beta chains comprise the amino acid sequences of SEQ ID NOs: 841 and 847, respectively; the alpha and beta chains comprise the amino acid sequences of SEQ ID NOs: 853 and 859, respectively; the alpha and beta chains comprise the amino acid sequences of SEQ ID NOs: 865 and 871, respectively; the alpha and beta chains comprise the amino acid sequences of SEQ ID NOs: 877 and 883, respectively; the alpha and beta chains comprise the amino acid sequences of SEQ ID NOs: 891 and 897, respectively; the alpha and beta chains comprise the amino acid sequences of SEQ ID NOs: 904 and 913, respectively; the alpha and beta chains comprise the amino acid sequences of SEQ ID NOs: 921 and 927, respectively; the alpha and beta chains comprise the amino acid sequences of SEQ ID NOs: 933 and 941, respectively; the alpha and beta chains comprise the amino acid sequences of SEQ ID NOs: 947 and 953, respectively; the alpha and beta chains comprise the amino acid sequences of SEQ ID NOs: 959 and 965, respectively; the alpha and beta chains comprise the amino acid sequences of SEQ ID NOs: 971 and 977, respectively; the alpha and beta chains comprise the amino acid sequences of SEQ ID NOs: 983 and 989, respectively; the alpha and beta chains comprise the amino acid sequences of SEQ ID NOs: 995 and 1004, respectively; or the alpha and beta chains comprise the amino acid sequences of SEQ ID NOs: 1386 and 1376, respectively.

In some embodiments, the TCR or antigen-binding fragment comprises one or more modifications in the α chain and/or β chain such that when the TCR or antigen-binding fragment thereof is expressed in a cell, the frequency of mispairing between the TCR α chain and β chain and an endogenous TCR α chain and β chain is reduced, the expression of the TCR α chain and β chain is increased and/or the stability of the TCR α chain and β chain is increased, each compared to expression in a cell of the TCR or antigen-binding fragment thereof not containing the one or more modifications. In some embodiments, the one or more modifications is a replacement, deletion, or insertion of one or more amino acids in the Cα region and/or the Cβ region. In some embodiments, the one or more modifications comprise replacement(s) to introduce one or more cysteine residues that are capable of forming one or more non-native disulfide bridges between the alpha chain and beta chain.

In some embodiments, the TCR comprises a Cα region containing a cysteine at a position corresponding to position 48 with numbering as set forth in SEQ ID NO: 212, 213, 217, 218, or 524 or at a position corresponding to position 49 with numbering as set forth in SEQ ID NO: 215 or 220; and/or a Cβ region containing a cysteine at a position corresponding to position 57 with numbering as set forth in SEQ ID NO: 214 or 216 or at a position corresponding to position 58 with numbering as set forth in SEQ ID NO: 631 or 889. In some embodiments, the Cα region contains the amino acid sequence set forth in any of SEQ ID NOs: 196, 198, 200, 201, 203, or 525, or a sequence of amino acids that has at least 90% sequence identity thereto containing one or more cysteine residues capable of forming a non-native disulfide bond with the beta chain; and/or the Cβ region contains the amino acid sequence set forth in any of SEQ ID NOs: 197, 199, 632, or 890 or a sequence of amino acids that has at least 90% sequence identity thereto that contains one or more cysteine residues capable of forming a non-native disulfide bond with the alpha chain.

In some embodiments, the TCR or antigen-binding fragment thereof is encoded by a nucleotide sequence that has been codon-optimized. In some embodiments, a) the alpha chain comprises: the amino acid sequence set forth in any of SEQ ID NOs: 688, 706, 723, 738, 756, 772, 784, 796, 812, 827, 842, 854, 866, 878, 892, 905, 922, 934, 948, 960, 972, 984, 996, or 1387, a sequence of amino acids that has at least 90% sequence identity thereto; or the amino acid sequence encoded by the nucleotide sequence set forth in any of SEQ ID NOs: 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, or 1385, or a nucleotide sequence that has at least 90% sequence identity thereto; and/or the beta chain comprises: the amino acid sequence set forth in any of SEQ ID NOs: 697, 715, 732, 747, 765, 778, 790, 805, 821, 836, 848, 860, 872, 884, 898, 914, 928, 942, 954, 966, 978, 990, 1005, or 1377, a sequence of amino acids that has at least 90% sequence identity thereto; or the amino acid sequence encoded by the nucleotide sequence set forth in SEQ ID NOS: 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, or 1375, or a nucleotide sequence that has at least 90% sequence identity thereto.

In some embodiments, the alpha and beta chains comprise the amino acid sequences of SEQ ID NOs: 688 and 697, respectively; the alpha and beta chains comprise the amino acid sequences of SEQ ID NOs: 706 and 715, respectively; the alpha and beta chains comprise the amino acid sequences of SEQ ID NOs: 723 and 732, respectively; the alpha and beta chains comprise the amino acid sequences of SEQ ID NOs: 738 and 747, respectively; the alpha and beta chains comprise the amino acid sequences of SEQ ID NOs: 756 and 765, respectively; the alpha and beta chains comprise the amino acid sequences of SEQ ID NOs: 772 and 778, respectively; the alpha and beta chains comprise the amino acid sequences of SEQ ID NOs: 784 and 790, respectively; the alpha and beta chains comprise the amino acid sequences of SEQ ID NOs: 796 and 805, respectively; the alpha and beta chains comprise the amino acid sequences of SEQ ID NOs: 812 and 821, respectively; the alpha and beta chains comprise the amino acid sequences of SEQ ID NOs: 827 and 836, respectively; the alpha and beta chains comprise the amino acid sequences of SEQ ID NOs: 842 and 848, respectively; the alpha and beta chains comprise the amino acid sequences of SEQ ID NOs: 854 and 860, respectively; the alpha and beta chains comprise the amino acid sequences of SEQ ID NOs: 866 and 872, respectively; the alpha and beta chains comprise the amino acid sequences of SEQ ID NOs: 878 and 884, respectively; the alpha and beta chains comprise the amino acid sequences of SEQ ID NOs: 892 and 898, respectively; the alpha and beta chains comprise the amino acid sequences of SEQ ID NOs: 905 and 914, respectively; the alpha and beta chains comprise the amino acid sequences of SEQ ID NOs: 922 and 928, respectively; the alpha and beta chains comprise the amino acid sequences of SEQ ID NOs: 934 and 942, respectively; the alpha and beta chains comprise the amino acid sequences of SEQ ID NOs: 948 and 954, respectively; the alpha and beta chains comprise the amino acid sequences of SEQ ID NOs: 960 and 966, respectively; the alpha and beta chains comprise the amino acid sequences of SEQ ID NOs: 972 and 978, respectively; the alpha and beta chains comprise the amino acid sequences of SEQ ID NOs: 984 and 990, respectively; or the alpha and beta chains comprise the amino acid sequences of SEQ ID NOs: 996 and 1005, respectively; or the alpha and beta chains comprise the amino acid sequences of SEQ ID NOs: 1387 and 1377, respectively.

In some embodiments, the alpha and/or beta chain further comprises a signal peptide.

In some embodiments, the alpha chain comprises the signal peptide containing the amino acid sequence set forth in any of SEQ ID NOs: 181, 184, 187, 189, 190, 192, 193, 310, 311; and/or the beta chain comprises the signal peptide containing the amino acid sequence set forth in any of SEQ ID NOs: 182, 185, 186, 188, 191, or 194.

In some embodiments, the provided TCR or antigen-binding fragment thereof is isolated or purified or is recombinant. In some embodiments, the provided TCR or antigen-binding fragment thereof is human. In some embodiments, the provided TCR or antigen-binding fragment thereof is monoclonal. In some embodiments, the provided TCR or antigen-binding fragment thereof is single chain. In some embodiments, the provided TCR or antigen-binding fragment thereof comprises two chains.

In some embodiments of the provided TCR or antigen-binding fragment thereof, the antigen-specificity is at least partially CD8-independent.

In some embodiments of the provided TCR or antigen-binding fragment thereof, the MHC molecule is an HLA-A2 molecule.

Also provided herein are nucleic acid molecules encoding any of the TCR or antigen-binding fragment thereof described herein, or an alpha or beta chain thereof.

In some embodiments, the nucleic acid molecule contains a nucleotide sequence encoding an alpha chain and/or a nucleotide sequence encoding a beta chain, wherein: the nucleotide sequence encoding an alpha chain comprises the sequence set forth in any of SEQ ID NOS: 1049, 1051, 1055, 1057, 1059, 1061, 1063, 1065, 1067, 1069, 1071, 1073, 1075, 1077, 1079, 1081, 1083, 1085, 1087, 1089, 1091, or a nucleotide sequence that has at least 90% sequence identity thereto; the nucleotide sequence encoding a beta chain comprises the sequence set forth in SEQ ID NOS: 1050, 1052, 1056, 1058, 1060, 1062, 1064, 1066, 1068, 1070, 1072, 1074, 1076, 1078, 1080, 1082, 1084, 1086, 1088, 1090 or 1092, or a nucleotide sequence that has at least 90% sequence identity thereto.

In some embodiments, the nucleotide sequence is codon-optimized.

In some embodiments, the nucleic acid molecule contains a nucleotide sequence encoding an alpha chain and/or a nucleotide sequence encoding a beta chain, wherein: the nucleotide sequence encoding an alpha chain comprises the sequence to set forth in any of SEQ ID NOS: 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, or 1385, or a nucleotide sequence that has at least 90% sequence identity thereto; the nucleotide sequence encoding a beta chain comprises the sequence set forth in SEQ ID NOS: 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, or 1375, or a nucleotide sequence that has at least 90% sequence identity thereto.

In some embodiments, the nucleotide sequence encoding the alpha chain and the nucleotide sequence encoding the beta chain are separated by a peptide sequence that causes ribosome skipping. In some embodiments, the peptide that causes ribosome skipping is a P2A or T2A peptide and/or comprises the sequence of amino acids set forth in SEQ ID NO: 204 or 211.

In some embodiments, the nucleic acid molecule contains the nucleotide sequence set forth in any of SEQ ID NOs: 448, 449, 450, 451, 452, 453, 454, 455, 456, 457, 458, 459, 460, 461, 462, 463, 464, 465, 466, 467, 468, 469, 470, 471, 472, or 1382, or a nucleotide sequence having at least 90% sequence identity thereto.

Also provided herein are T cell receptors (TCRs) or antigen-binding fragment thereof, containing an alpha chain containing a variable alpha (Vα) region and a beta chain containing a variable beta (Vβ) region, wherein: the Vα region contains the amino acid sequence set forth in any of SEQ ID NOs: 477, 492, 504, 510, 522, 536, 554, 569, 587, 599, 611, 623, 637, 649, 661 or 676, or an amino acid sequence that has at least 90%, 91%, 92%, 93%, 94%, 95%, 96%, 97%, 98%, or 99% sequence identity thereto; and/or the Vβ region contains the amino acid sequence set forth in any of SEQ ID NOs: 483, 498, 516, 530, 545, 560, 578, 593, 605, 617, 629, 643, 655, 667 or 685, or an amino acid sequence that has at least 90%, 91%, 92%, 93%, 94%, 95%, 96%, 97%, 98%, or 99% sequence identity thereto.

In some embodiments, the Vα region contains a complementarity determining region 3 (CDR-3) containing the amino acid sequence $AX_2RX_4AX_6NNDMR$, wherein $X_2$ is V, or M; $X_4$ is P, or D; and $X_6$ is N, or R (SEQ ID NO: 1221). In some embodiments, the Vβ region contains a complementarity determining region 3 (CDR-3) containing the amino acid sequence $ASSX_4WGX_7SNQPX_{12}H$, wherein $X_4$ is L, F, or P; $X_7$ is R, or Q; and $X_{12}$ is Q, or L(SEQ ID NO: 1216); or the Vβ region contains a complementarity determining region 3 (CDR-3) containing the amino acid sequence $ASSX_4X_5X_6X_7X_8SGNTIY$, wherein $X_4$ is L, or R; $X_5$ is W, or Q; $X_6$ is G, or P; $X_7$ is R, or S; and $X_8$ is S, or null (SEQ ID NO:1217).

Also provided herein are T cell receptors (TCRs) or antigen-binding fragment thereof, containing an alpha chain containing a variable alpha (Vα) region and a beta chain containing a variable beta (Vβ) region, wherein the Vα region contains a complementarity determining region 3 (CDR-3) containing the amino acid sequence $AX_2RX_4AX_6NNDMR$, wherein $X_2$ is V, or M; $X_4$ is P, or D; and $X_6$ is N, or R (SEQ ID NO: 1221).

Also provided herein are T cell receptors (TCRs) or antigen-binding fragment thereof, containing an alpha chain containing a variable alpha (Vα) region and a beta chain containing a variable beta (Vβ) region, wherein: the Vβ region contains a complementarity determining region 3 (CDR-3) containing the amino acid sequence $ASSX_4WGX_7SNQPX_{12}H$, wherein $X_4$ is L, F, or P; $X_7$ is R, or Q; and $X_{12}$ is Q, or L (SEQ ID NO:1216); or the Vβ region contains a complementarity determining region 3 (CDR-3) containing the amino acid sequence $ASSX_4X_5X_6X_7X_8SGNTIY$, wherein $X_4$ is L, or R; $X_5$ is W, or Q; $X_6$ is G, or P; $X_7$ is R, or S; and $X_8$ is S, or null (SEQ ID NO:1217).

Also provided herein are T cell receptors (TCRs) or antigen-binding fragment thereof, containing an alpha chain containing a variable alpha (Vα) region and a beta chain containing a variable beta (Vβ) region, wherein: the Vα region contains a complementarity determining region 3 (CDR-3) set forth in any of SEQ ID NOs: 478, 493, 505, 511, 523, 539, 555, 572, 588, 600, 612, 624, 638, 650, 662 or 679, or a sequence that exhibits at least 60%, 65%, 70%, 75%, 80%, 85%, 90% or 95% sequence identity thereto; the Vβ region contains a complementarity determining region 3 (CDR-3) set forth in any of SEQ ID NOs: 486, 499, 517, 531, 548, 563, 581, 594, 606, 618, 630, 644, 656, 670 or 686, or a sequence that exhibits at least 60%, 65%, 70%, 75%, 80%, 85%, 90% or 95% sequence identity thereto.

In any of some of the embodiments provided herein, the Vα region contains: a complementarity determining region 1 (CDR-1) containing the amino acid sequence $X_1X_2X_3X_4X_5X_6$ (SEQ ID NO: 1191), wherein $X_1$ is N, S, D, T, or V; $X_2$ is S, V, R, T, or I; $X_3$ is M, F, G, S, N, A, L, V, or P; $X_4$ is F, S, N, A, or null; $X_5$ is D, S, Q, Y, N, V, T, or P; and $X_6$ is Y, S, R, N, G, or T; and/or a complementarity determining region 2 (CDR-2) containing the amino acid sequence $X_1X_2X_3X_4X_5X_6X_7X_8$ (SEQ ID NO:1192), wherein $X_1$ is I, V, L, G, N, T, Y, or M; $X_2$ is S, V, Y, L, P, F, I, or T; $X_3$ is S, Y, K, L, T, or F; $X_4$ is I, G, N, A, S, or null; $X_5$ is S, D, or null; $X_6$ is K, G, N, S, D, T, or E; $X_7$ is D, E, G, A, K, L, or N; and $X_8$ is K, V, D, P, N, T, L, or M.

In any of some of the embodiments provided herein, the Vβ region contains: a complementarity determining region 1 (CDR-1) containing the amino acid sequence $SX_2X_3X_4X_5$ (SEQ ID NO:1203), wherein $X_2$ is G, or N; $X_3$ is H, or D;

X₄ is T, L, N, or V; and X₅ is A, S, Y, or T; and/or a complementarity determining region 2 (CDR-2) containing the amino acid sequence X₁X₂X₃X₄X₅X₆ (SEQ ID NO:1204), wherein X₁ is F, or Y; X₂ is Q, Y, or N; X₃ is G, N, R, or Y; X₄ is N, G, E, or T; X₅ is S, E, A, or G; and X₆ is A, E, I, or Q.

In some embodiments, the TCR or antigen-binding fragment thereof binds to or recognizes a peptide epitope of human papillomavirus (HPV) 16 E6 in the context of an MHC molecule, the peptide epitope is or comprises E6(29-38) TIHDIILECV (SEQ ID NO:233).

In some embodiments, the Vα region contains a complementarity determining region 3 (CDR-3) containing the amino acid sequence set forth in any of SEQ ID NOs: 478, 493, 505, 511, 523, 539, 555, 572, 588, 600, 612, 624, 638, 650, 662 or 679, or a CDR3 contained within the amino acid sequence set forth in any of SEQ ID NOs: 477, 492, 504, 510, 522, 536, 554, 569, 587, 599, 611, 623, 637, 649, 661 or 676; and/or the Vβ region contains a complementarity determining region 3 (CDR-3) containing an amino acid sequence set forth in any of SEQ ID NOs: 486, 499, 517, 531, 548, 563, 581, 594, 606, 618, 630, 644, 656, 670 or 686 or a CDR3 contained within the amino acid sequence set forth in any of SEQ ID NOs: 483, 498, 516, 530, 545, 560, 578, 593, 605, 617, 629, 643, 655, 667 or 685.

In some embodiments, the Vα region also contains: a complementarity determining region 1 (CDR-1) containing an amino acid sequence set forth in any of SEQ ID NOs: 136, 161, 165, 537, 570, 142, 171 or 677; and/or a complementarity determining region 2 (CDR-2) containing an amino acid sequence set forth in any of SEQ ID NOs: 137, 162, 166, 538, 571, 143, 172 or 678.

In some embodiments, the Vβ region contains: a complementarity determining region 1 (CDR-1) containing the amino acid sequence set forth in any of SEQ ID NOs: 484, 148, 546, 561, 579, 168, 668 or 154; and/or a complementarity determining region 2 (CDR-2) containing the amino acid sequence set forth in any of SEQ ID NOs: 485, 149, 547, 562, 580, 169, 669 or 155.

In some embodiments, the Vα region contains a CDR-1, CDR-2, and CDR-3, containing the amino acid sequences of SEQ ID NOs: 136, 137 and 478, respectively, and the Vβ region contains a CDR-1, CDR-2, and CDR-3, containing the amino acid sequences of SEQ ID NOs: 484, 485 and 486, respectively; the Vα region contains a CDR-1, CDR-2, and CDR-3, containing the amino acid sequences of SEQ ID NOs: 161, 162 and 493, respectively, and the Vβ region contains a CDR-1, CDR-2, and CDR-3, containing the amino acid sequences of SEQ ID NOs: 148, 149 and 499, respectively; the Vα region contains a CDR-1, CDR-2, and CDR-3, containing the amino acid sequences of SEQ ID NOs: 165, 166 and 505, respectively, and the Vβ region contains a CDR-1, CDR-2, and CDR-3, containing the amino acid sequences of SEQ ID NOs: 148, 149 and 499, respectively; the Vα region contains a CDR-1, CDR-2, and CDR-3, containing the amino acid sequences of SEQ ID NOs: 161, 162 and 511, respectively, and the Vβ region contains a CDR-1, CDR-2, and CDR-3, containing the amino acid sequences of SEQ ID NOs: 148, 149 and 517, respectively; the Vα region contains a CDR-1, CDR-2, and CDR-3, containing the amino acid sequences of SEQ ID NOs: 136, 137 and 523, respectively, and the Vβ region contains a CDR-1, CDR-2, and CDR-3, containing the amino acid sequences of SEQ ID NOs: 148, 149 and 531, respectively; the Vα region contains a CDR-1, CDR-2, and CDR-3, containing the amino acid sequences of SEQ ID NOs: 537, 538, and 539, respectively, and the Vβ region contains a CDR-1, CDR-2, and CDR-3, containing the amino acid sequences of SEQ ID NOs: 546, 547 and 548, respectively; the Vα region contains a CDR-1, CDR-2, and CDR-3, containing the amino acid sequences of SEQ ID NOs: 136, 137 and 555, respectively, and the Vβ region contains a CDR-1, CDR-2, and CDR-3, containing the amino acid sequences of SEQ ID NOs: 561, 562 and 563, respectively; the Vα region contains a CDR-1, CDR-2, and CDR-3, containing the amino acid sequences of SEQ ID NOs: 570, 571 and 572, respectively, and the Vβ region contains a CDR-1, CDR-2, and CDR-3, containing the amino acid sequences of SEQ ID NOs: 579, 580 and 581, respectively; the Vα region contains a CDR-1, CDR-2, and CDR-3, containing the amino acid sequences of SEQ ID NOs: 136, 137 and 600, respectively, and the Vβ region contains a CDR-1, CDR-2, and CDR-3, containing the amino acid sequences of SEQ ID NOs: 148, 149 and 594, respectively; the Vα region contains a CDR-1, CDR-2, and CDR-3, containing the amino acid sequences of SEQ ID NOs: 136, 137 and 600, respectively, and the Vβ region contains a CDR-1, CDR-2, and CDR-3, containing the amino acid sequences of SEQ ID NOs: 148, 149 and 606, respectively; the Vα region contains a CDR-1, CDR-2, and CDR-3, containing the amino acid sequences of SEQ ID NOs: 136, 137 and 612, respectively, and the Vβ region contains a CDR-1, CDR-2, and CDR-3, containing the amino acid sequences of SEQ ID NOs: 148, 149 and 618, respectively; the Vα region contains a CDR-1, CDR-2, and CDR-3, containing the amino acid sequences of SEQ ID NOs: 136, 137 and 624, respectively, and the Vβ region contains a CDR-1, CDR-2, and CDR-3, containing the amino acid sequences of SEQ ID NOs: 168, 169 and 630, respectively; the Vα region contains a CDR-1, CDR-2, and CDR-3, containing the amino acid sequences of SEQ ID NOs: 142, 143 and 638, respectively, and the Vβ region contains a CDR-1, CDR-2, and CDR-3, containing the amino acid sequences of SEQ ID NOs: 561, 562 and 644, respectively; the Vα region contains a CDR-1, CDR-2, and CDR-3, containing the amino acid sequences of SEQ ID NOs: 171, 172 and 650, respectively, and the Vβ region contains a CDR-1, CDR-2, and CDR-3, containing the amino acid sequences of SEQ ID NOs: 148, 149 and 656, respectively; the Vα region contains a CDR-1, CDR-2, and CDR-3, containing the amino acid sequences of SEQ ID NOs: 136, 137 and 662, respectively, and the Vβ region contains a CDR-1, CDR-2, and CDR-3, containing the amino acid sequences of SEQ ID NOs: 668, 669 and 670, respectively; or the Vα region contains a CDR-1, CDR-2, and CDR-3, containing the amino acid sequences of SEQ ID NOs: 677, 678 and 679, respectively, and the Vβ region contains a CDR-1, CDR-2, and CDR-3, containing the amino acid sequences of SEQ ID NOs: 154, 155 and 686, respectively.

In some embodiments, the Vα region contains a complementarity determining region 1 (CDR-1), a CDR-2, and a CDR-3, respectively containing the CDR-1, CDR-2, and CDR-3 amino acid sequences contained within a Vα region amino acid sequence set forth in any of SEQ ID NOs: 477, 492, 504, 510, 522, 536, 554, 569, 587, 599, 611, 623, 637, 649, 661 or 676; and/or the Vβ region contains a complementarity determining region 1 (CDR-1), a CDR-2, and a CDR-3, respectively containing the CDR-1, CDR-2, and CDR-3 amino acid sequences contained within a Vβ region amino acid sequence set forth in any of SEQ ID NOs: 483, 498, 516, 530, 545, 560, 578, 593, 605, 617, 629, 643, 655, 667 or 685.

In some embodiments, the Vα and Vβ regions comprise the amino acid sequences of SEQ ID NOs: 477 and 483, respectively; the Vα and Vβ regions comprise the amino acid sequences of SEQ ID NOs: 492 and 498, respectively; the Vα and Vβ regions comprise the amino acid sequences of SEQ ID NOs: 504 and 498, respectively; the Vα and Vβ regions comprise the amino acid sequences of SEQ ID NOs: 510 and 516, respectively; the Vα and Vβ regions comprise the amino acid sequences of SEQ ID NOs: 522 and 530, respectively; the Vα and Vβ regions comprise the amino acid sequences of SEQ ID NOs: 536 and 545, respectively; the Vα and Vβ regions comprise the amino acid sequences of SEQ ID NOs: 554 and 560, respectively; the Vα and Vβ regions comprise the amino acid sequences of SEQ ID NOs: 569 and 578, respectively; the Vα and Vβ regions comprise the amino acid sequences of SEQ ID NOs: 587 and 593, respectively; the Vα and Vβ regions comprise the amino acid sequences of SEQ ID NOs: 599 and 605, respectively; the Vα and Vβ regions comprise the amino acid sequences of SEQ ID NOs: 611 and 617, respectively; the Vα and Vβ regions comprise the amino acid sequences of SEQ ID NOs: 623 and 629, respectively; the Vα and Vβ regions comprise the amino acid sequences of SEQ ID NOs: 637 and 643, respectively; the Vα and Vβ regions comprise the amino acid sequences of SEQ ID NOs: 649 and 655, respectively; the Vα and Vβ regions comprise the amino acid sequences of SEQ ID NOs: 661 and 667, respectively; the Vα and Vβ regions comprise the amino acid sequences of SEQ ID NOs:676 and 685, respectively.

In some embodiments, the alpha chain further comprises an alpha constant (Cα) region and/or the beta chain further comprises a beta constant (Cβ) region.

In some embodiments, the Cα and Cβ regions are mouse constant regions.

In some embodiments, the Cα region contains the amino acid sequence set forth in SEQ ID NO: 262, 833, 1012, 1014, 1015, 1017, 1018, or 1362, or a sequence of amino acids that has at least 90% sequence identity thereto; and/or the Cβ region contains the amino acid sequence set forth in SEQ ID NO: 263, 1013 or 1016 or a sequence of amino acids that has at least 90% sequence identity thereto.

In some embodiments, the Cα and Cβ regions are human constant regions. In some embodiments, the Cα region contains the amino acid sequence set forth in any of SEQ ID NOs: 212, 213, 215, 217, 218, 220 or 524, or a sequence of amino acids that has at least 90% sequence identity thereto; and/or the Cβ region contains the amino acid sequence set forth in any of SEQ ID NOs: 214, 216, 631 or 889, or a sequence of amino acids that has at least 90% sequence identity thereto.

In some embodiments, a) the alpha chain comprises: the amino acid sequence set forth in any of SEQ ID NOs: 473, 488, 500, 506, 518, 532, 550, 565, 583, 595, 607, 619, 633, 645, 657 or 672, a sequence of amino acids that has at least 90% sequence identity thereto; or the amino acid sequence encoded by the nucleotide sequence set forth in any of SEQ ID NOs: 389, 430, 1019, 1021, 1023, 1025, 1027, 1029, 1031, 1033, 1035, 1037, 1039, 1041, 1043 or 1045, or a nucleotide sequence that has at least 90% sequence identity thereto; and/or the beta chain comprises: the amino acid sequence set forth in any of SEQ ID NOs: 479, 494, 512, 526, 541, 556, 574, 589, 601, 613, 625, 639, 651, 663 or 681, a sequence of amino acids that has at least 90% sequence identity thereto; or the amino acid sequence encoded by the nucleotide sequence set forth in SEQ ID NOS: 390, 431, 1020, 1022, 1024, 1026, 1028, 1030, 1032, 1034, 1036, 1038, 1040, 1042, 1044 or 1046, or a nucleotide sequence that has at least 90% sequence identity thereto.

In some embodiments, the alpha and beta chains comprise the amino acid sequences of SEQ ID NOs: 473 and 479, respectively; the alpha and beta chains comprise the amino acid sequences of SEQ ID NOs: 488 and 494, respectively; the alpha and beta chains comprise the amino acid sequences of SEQ ID NOs: 500 and 494, respectively; the alpha and beta chains comprise the amino acid sequences of SEQ ID NOs: 506 and 512, respectively; the alpha and beta chains comprise the amino acid sequences of SEQ ID NOs: 518 and 526, respectively; the alpha and beta chains comprise the amino acid sequences of SEQ ID NOs: 532 and 541, respectively; the alpha and beta chains comprise the amino acid sequences of SEQ ID NOs: 550 and 556, respectively; the alpha and beta chains comprise the amino acid sequences of SEQ ID NOs: 565 and 574, respectively; the alpha and beta chains comprise the amino acid sequences of SEQ ID NOs: 583 and 589, respectively; the alpha and beta chains comprise the amino acid sequences of SEQ ID NOs: 595 and 601, respectively; the alpha and beta chains comprise the amino acid sequences of SEQ ID NOs: 607 and 613, respectively; the alpha and beta chains comprise the amino acid sequences of SEQ ID NOs: 619 and 625, respectively; the alpha and beta chains comprise the amino acid sequences of SEQ ID NOs: 633 and 639, respectively; the alpha and beta chains comprise the amino acid sequences of SEQ ID NOs: 645 and 651, respectively; the alpha and beta chains comprise the amino acid sequences of SEQ ID NOs: 657 and 663, respectively; or the alpha and beta chains comprise the amino acid sequences of SEQ ID NOs: 672 and 681, respectively.

In some embodiments, the TCR or antigen-binding fragment comprises one or more modifications in the α chain and/or β chain such that when the TCR or antigen-binding fragment thereof is expressed in a cell, the frequency of mispairing between the TCR α chain and β chain and an endogenous TCR α chain and β chain is reduced, the expression of the TCR α chain and β chain is increased and/or the stability of the TCR α chain and β chain is increased, each compared to expression in a cell of the TCR or antigen-binding fragment thereof not containing the one or more modifications. In some embodiments, the one or more modifications is a replacement, deletion, or insertion of one or more amino acids in the Cα region and/or the Cβ region. In some embodiments, the one or more modifications comprise replacement(s) to introduce one or more cysteine residues that are capable of forming one or more non-native disulfide bridges between the alpha chain and beta chain. In some embodiments, containing a Cα region containing a cysteine at a position corresponding to position 48 with numbering as set forth in SEQ ID NO: 212, 213, 217, 218, or 524 or at a position corresponding to position 49 with numbering as set forth in SEQ ID NO: 215 or 220; and/or a Cβ region containing a cysteine at a position corresponding to position 57 with numbering as set forth in SEQ ID NO: 214 or 216 or at a position corresponding to position 58 with numbering as set forth in SEQ ID NO: 631 or 889.

In some embodiments, the Cα region contains the amino acid sequence set forth in any of SEQ ID NOs: 196, 198, 200, 201, 203, or 525, or a sequence of amino acids that has at least 90% sequence identity thereto containing one or more cysteine residues capable of forming a non-native disulfide bond with the beta chain; and/or the Cβ region contains the amino acid sequence set forth in any of SEQ ID NOs: 197, 199, 632, or 890 or a sequence of amino acids that has at least 90% sequence identity thereto that contains one or more cysteine residues capable of forming a non-native disulfide bond with the alpha chain.

In some embodiments, the TCR or antigen-binding fragment thereof is encoded by a nucleotide sequence that has been codon-optimized.

In some embodiments, a) the alpha chain comprises: the amino acid sequence set forth in any of SEQ ID NOs: 474, 489, 501, 507, 519, 533, 551, 566, 584, 596, 608, 620, 634, 646, 658 or 673, a sequence of amino acids that has at least 90% sequence identity thereto; or the amino acid sequence encoded by the nucleotide sequence set forth in any of SEQ ID NOs: 1097, 1099, 1101, 1103, 1105, 1107, 1109, 1111, 1113, 1115, 1117, 1119, 1121, 1123, 1125 or 1127, or a nucleotide sequence that has at least 90% sequence identity thereto; and/or the beta chain comprises: the amino acid sequence set forth in any of SEQ ID NOs: 480, 495, 513, 527, 542, 557, 575, 590, 602, 614, 626, 640, 652, 664 or 682, a sequence of amino acids that has at least 90% sequence identity thereto; or the amino acid sequence encoded by the nucleotide sequence set forth in SEQ ID NOS: 1098, 1100, 1102, 1104, 1106, 1108, 1110, 1112, 1114, 1116, 1118, 1120, 1122, 1124, 1126 or 1128, or a nucleotide sequence that has at least 90% sequence identity thereto.

In some embodiments, the alpha and beta chains comprise the amino acid sequences of SEQ ID NOs: 474 and 482, respectively; the alpha and beta chains comprise the amino acid sequences of SEQ ID NOs: 489 and 497, respectively; the alpha and beta chains comprise the amino acid sequences of SEQ ID NOs: 501 and 497, respectively; the alpha and beta chains comprise the amino acid sequences of SEQ ID NOs: 507 and 515, respectively; the alpha and beta chains comprise the amino acid sequences of SEQ ID NOs: 519 and 529, respectively; the alpha and beta chains comprise the amino acid sequences of SEQ ID NOs: 533 and 544, respectively; the alpha and beta chains comprise the amino acid sequences of SEQ ID NOs: 551 and 559, respectively; the alpha and beta chains comprise the amino acid sequences of SEQ ID NOs: 566 and 577, respectively; the alpha and beta chains comprise the amino acid sequences of SEQ ID NOs: 584 and 592, respectively; the alpha and beta chains comprise the amino acid sequences of SEQ ID NOs: 596 and 604, respectively; the alpha and beta chains comprise the amino acid sequences of SEQ ID NOs: 608 and 616, respectively; the alpha and beta chains comprise the amino acid sequences of SEQ ID NOs: 620 and 628, respectively; the alpha and beta chains comprise the amino acid sequences of SEQ ID NOs: 634 and 642, respectively; the alpha and beta chains comprise the amino acid sequences of SEQ ID NOs: 646 and 654, respectively; the alpha and beta chains comprise the amino acid sequences of SEQ ID NOs: 658 and 666, respectively; or the alpha and beta chains comprise the amino acid sequences of SEQ ID NOs: 673 and 684, respectively.

In some embodiments, the alpha and/or beta chain further comprises a signal peptide. In some embodiments, the alpha chain comprises the signal peptide containing the amino acid sequence set forth in any of SEQ ID NOs: 181, 184, 187, 189, 190, 192, 193, 310, 311; and/or the beta chain comprises the signal peptide containing the amino acid sequence set forth in any of SEQ ID NOs: 182, 185, 186, 188, 191, or 194.

In some embodiments, the provided TCR or antigen-binding fragment thereof is isolated or purified or is recombinant. In some embodiments, the provided TCR or antigen-binding fragment thereof is human. In some embodiments, the provided TCR or antigen-binding fragment thereof is monoclonal. In some embodiments, the provided TCR or antigen-binding fragment thereof is single chain. In some embodiments, the provided TCR or antigen-binding fragment thereof comprises two chains.

In some embodiments of the provided TCR or antigen-binding fragment thereof, the antigen-specificity is at least partially CD8-independent.

In some embodiments of the provided TCR or antigen-binding fragment thereof, the MHC molecule is an HLA-A2 molecule.

Also provided herein are nucleic acid molecules encoding any of the TCR or antigen-binding fragment thereof described herein, or an alpha or beta chain thereof.

In some embodiments, the provided nucleic acid molecule contains a nucleotide sequence encoding an alpha chain and/or a nucleotide sequence encoding a beta chain, wherein: the nucleotide sequence encoding an alpha chain comprises the sequence set forth in any of SEQ ID NOS: 389, 430, 1019, 1021, 1023, 1025, 1027, 1029, 1031, 1033, 1035, 1037, 1039, 1041, 1043 or 1045, or a nucleotide sequence that has at least 90% sequence identity thereto; the nucleotide sequence encoding a beta chain comprises the sequence set forth in SEQ ID NOS: 390, 431, 1020, 1022, 1024, 1026, 1028, 1030, 1032, 1034, 1036, 1038, 1040, 1042, 1044 or 1046, or a nucleotide sequence that has at least 90% sequence identity thereto.

In some embodiments, the nucleotide sequence is codon-optimized.

In some embodiments, the provided nucleic acid molecule contains a nucleotide sequence encoding an alpha chain and/or a nucleotide sequence encoding a beta chain, wherein: the nucleotide sequence encoding an alpha chain comprises the sequence to set forth in any of SEQ ID NOS: 1097, 1099, 1101, 1103, 1105, 1107, 1109, 1111, 1113, 1115, 1117, 1119, 1121, 1123, 1125 or 1127, or a nucleotide sequence that has at least 90% sequence identity thereto; the nucleotide sequence encoding a beta chain comprises the sequence set forth in SEQ ID NOS: 1098, 1100, 1102, 1104, 1106, 1108, 1110, 1112, 1114, 1116, 1118, 1120, 1122, 1124, 1126 or 1128, or a nucleotide sequence that has at least 90% sequence identity thereto.

In some embodiments, the nucleotide sequence encoding the alpha chain and the nucleotide sequence encoding the beta chain are separated by a peptide sequence that causes ribosome skipping. In some embodiments, the peptide that causes ribosome skipping is a P2A or T2A peptide and/or comprises the sequence of amino acids set forth in SEQ ID NO: 204 or 211.

In some embodiments, the provided nucleic acid molecule contains the nucleotide sequence set forth in any of SEQ ID NOs: 432, 433, 434, 435, 436, 437, 438, 439, 440, 441, 442, 443, 444, 445, 446 or 447, or a nucleotide sequence having at least 90% sequence identity thereto.

In some embodiments, the nucleic acid is synthetic. In some embodiments, the nucleic acid is cDNA.

Also provided herein are polynucleotides containing (a) a nucleic acid sequence encoding any one of the TCR or an antigen-binding portion thereof provided herein, or containing the nucleic acid molecule of encoding any of the provided TCR or an antigen-binding fragment thereof provided herein, and (b) one or more homology arm(s) linked to the nucleic acid sequence, wherein the one or more homology arms comprise a sequence homologous to one or more region(s) of an open reading frame of a T cell receptor alpha constant (TRAC) locus.

Also provided herein in a polynucleotide, containing (a) a nucleic acid sequence encoding a portion of a T cell receptor (TCR), said nucleic acid sequence encoding (i) a T cell receptor beta (TCRβ) chain comprising a variable beta (Vβ) of any one of the TCR or antigen-binding fragment thereof provided herein and a constant beta (Cβ); and (ii) a portion of a T cell receptor alpha (TCRα) chain comprising a variable alpha (Vα) of the any one of the TCR or antigen-binding fragment thereof provided herein, wherein the portion of the TCRα chain is less than a full-length TCRα chain, and (b) one or more homology arm(s) linked to the nucleic acid sequence, wherein the one or more homology arms comprise a sequence homologous to one or more region(s) of an open reading frame of a T cell receptor alpha constant (TRAC) locus.

In some embodiments of any of the polynucleotides provided herein, the TCRα chain comprises a constant alpha (Cα), wherein at least a portion of said Cα is encoded by the open reading frame of the endogenous TRAC locus or a partial sequence thereof when the TCR or antigen-binding fragment thereof is expressed from a cell introduced with the polynucleotide. In some embodiments of any of the polynucleotides provided herein, the nucleic acid sequence of (a) and the one of the one or more homology arms together comprise a sequence of nucleotides encoding the Cα that is less than the full length of a native Cα, wherein at least a portion of the Cα is encoded by the open reading frame of the endogenous TRAC locus or a partial sequence thereof when the TCR or antigen-binding fragment thereof is expressed from a cell introduced with the polynucleotide. In some embodiments, the nucleic acid sequence encoding the TCRβ chain is upstream of the nucleic acid sequence encoding the portion of the TCRα chain.

In some embodiments of any of the polynucleotides provided herein, the nucleic acid sequence of (a) does not comprise an intron. In some embodiments, the nucleic acid sequence of (a) is a sequence that is exogenous or heterologous to an open reading frame of an endogenous genomic TRAC locus of a T cell, optionally a human T cell. In some embodiments, the nucleic acid sequence of (a) is in-frame with one or more exons or a partial sequence thereof, optionally exon 1 or a partial sequence thereof, of the open reading frame of the TRAC locus comprised in the one or more homology arm(s). In some embodiments, a portion of the Cα is encoded by the open reading frame of the endogenous TRAC locus or a partial sequence thereof, and a further portion of the Cα is encoded by the nucleic acid sequence of (a), wherein said further portion of Cα is less than the full length of a native Ca. In some embodiments, the further portion of the Cα is encoded by a sequence of nucleotides starting from residue 3 and up to residue 3155 of the sequence set forth in SEQ ID NO:348 or one or more exons thereof or a sequence that exhibits at least 85%, 86%, 87%, 88%, 89%, 90%, 91%, 92%, 93%, 94%, 95%, 96%, 97%, 98%, 99% or more sequence identity to a sequence of nucleotides starting from residue 3 and up to residue 3155 of the sequence set forth in SEQ ID NO:348 or one or more exons thereof, or a partial sequence thereof. In some embodiments, the further portion of the Cα is encoded by a sequence set forth in SEQ ID NO:1364, or a sequence that exhibits at least 85%, 86%, 87%, 88%, 89%, 90%, 91%, 92%, 93%, 94%, 95%, 96%, 97%, 98%, 99% or more sequence identity to SEQ ID NO:1364, or a partial sequence thereof. In some embodiments, the further portion of the Cα and/or the Cβ region encoded by the nucleic acid sequence of (a) comprises one or more modifications, optionally a replacement, deletion, or insertion of one or more amino acids compared to a native Cα region and/or a native Cβ region, optionally said one or more modifications introduces one or more cysteine residues that are capable of forming one or more non-native disulfide bridges between the alpha chain and beta chain.

In some embodiments of any of the polynucleotides provided herein, the one or more homology arm comprises a 5' homology arm and/or a 3' homology arm. In some embodiments, the 5' homology arm comprises: a) a sequence comprising at or at least at or at least 150, 200, 250, 300, 350, 400, 450, 500, 550, or 600 contiguous nucleotides of a sequence that exhibits at least 85%, 86%, 87%, 88%, 89%, 90%, 91%, 92%, 93%, 94%, 95%, 96%, 97%, 98%, 99% or more sequence identity to the sequence set forth in SEQ ID NO: 1343; b) a sequence comprising at or at least at or at least 150, 200, 250, 300, 350, 400, 450, 500, 550, or 600 contiguous nucleotides of the sequence set forth in SEQ ID NO: 1343; or c) the sequence set forth in SEQ ID NO: 1343. In some embodiments, the 3' homology arm comprises: a) a sequence comprising at or at least at or at least 150, 200, 250, 300, 350, 400, 450, 500, 550, or 600 contiguous nucleotides of a sequence that exhibits at least 85%, 86%, 87%, 88%, 89%, 90%, 91%, 92%, 93%, 94%, 95%, 96%, 97%, 98%, 99% or more sequence identity to the sequence set forth in SEQ ID NO: 1344; b) a sequence comprising at or at least at or at least 150, 200, 250, 300, 350, 400, 450, 500, 550, or 600 contiguous nucleotides of the sequence set forth in SEQ ID NO: 1344; or c) the sequence set forth in SEQ ID NO: 1344.

Provided herein is a polynucleotide containing (a) a nucleic acid sequence encoding any one of the TCRs or antigen-binding fragments herein, or any one of the nucleic acid molecules provided herein encoding a TCR or antigen-binding fragment thereof, and (b) one or more homology arm(s) linked to the nucleic acid sequence, wherein the one or more homology arms comprise a sequence homologous to one or more region(s) of an open reading frame of a T cell receptor beta constant (TRBC) locus.

Provided herein is a polynucleotide containing (a) a nucleic acid sequence encoding a portion of a T cell receptor (TCR), said nucleic acid sequence encoding (i) a T cell receptor alpha (TCRα) chain comprising a variable alpha (Vα) of any one of the TCR or antigen-binding fragment thereof provided herein, and a constant alpha (Cα); and (ii) a portion of a T cell receptor beta (TCRβ) chain comprising a variable beta (Vβ) of the any one of the TCR or antigen-binding fragment thereof, wherein the portion of the TCRβ chain is less than a full-length TCRβ chain, and (b) one or more homology arm(s) linked to the nucleic acid sequence, wherein the one or more homology arms comprise a sequence homologous to one or more region(s) of an open reading frame of a T cell receptor beta constant (TRBC) locus.

In some embodiments of any of the provided polynucleotides, the TCRβ chain comprises a constant beta (Cβ), wherein at least a portion of said Cβ is encoded by the open reading frame of the endogenous TRBC locus or a partial sequence thereof, when the TCR or antigen-binding fragment thereof is expressed from a cell introduced with the polynucleotide. In some embodiments, the nucleic acid sequence of (a) and the one of the one or more homology arms together comprise a sequence of nucleotides encoding the Cβ that is less than the full length of a native Cβ, wherein at least a portion of the Cβ is encoded by the open reading frame of the endogenous TRAC locus or a partial sequence thereof when the TCR or antigen-binding fragment thereof is expressed from a cell introduced with the polynucleotide. In some embodiments, the nucleic acid sequence encoding the TCRα chain is upstream of the nucleic acid sequence encoding the portion of the TCRβ chain.

In some embodiments of any of the provided polynucleotides, the nucleic acid sequence of (a) does not comprise an intron. In some embodiments, the nucleic acid sequence of (a) is a sequence that is exogenous or heterologous to an open reading frame of an endogenous genomic TRBC locus of a T cell, optionally a human T cell. In some embodiments, the nucleic acid sequence of (a) is in-frame with one or more exons or a partial sequence thereof, optionally exon 1 or a partial sequence thereof, of the open reading frame of the TRBC locus comprised in the one or more homology arm(s). In some embodiments, a portion of the Cβ is encoded by the open reading frame of the endogenous TRBC locus or a partial sequence thereof, and a further portion of the Cβ is encoded by the nucleic acid sequence of (a), wherein said further portion of Cβ is less than the full length of a native Cβ. In some embodiments, the further portion of the Cβ is encoded by a sequence of nucleotides starting from residue 3 and up to residue 1445 of the sequence set forth in SEQ ID NO:349 or one or more exons thereof or a sequence that exhibits at least 85%, 86%, 87%, 88%, 89%, 90%, 91%, 92%, 93%, 94%, 95%, 96%, 97%, 98%, 99% or more sequence identity to a sequence of nucleotides starting from residue 3 and up to residue 1445 of the sequence set forth in SEQ ID NO:349 or one or more exons thereof, or a partial sequence thereof; or a sequence of nucleotides starting from residue 3 and up to residue 1486 of the sequence set forth in SEQ ID NO:1047 or one or more exons thereof or a sequence that exhibits at least 85%, 86%, 87%, 88%, 89%, 90%, 91%, 92%, 93%, 94%, 95%, 96%, 97%, 98%, 99% or more sequence identity to a sequence of nucleotides starting from residue 3 and up to residue 1486 of the sequence set forth in SEQ ID NO:1047 or one or more exons thereof, or a partial sequence thereof. In some embodiments, the further portion of the Cβ and/or the Cα region encoded by the nucleic acid sequence of (a) comprises one or more modifications, optionally a replacement, deletion, or insertion of one or more amino acids compared to a native Cβ region and/or a native Cα region, optionally said one or more modifications introduces one or more cysteine residues that are capable of forming one or more non-native disulfide bridges between the alpha chain and beta chain.

In some embodiments of any of the provided polynucleotides, the one or more homology arm comprises a 5' homology arm and/or a 3' homology arm.

In some embodiments of any of the provided polynucleotides, the nucleic acid sequence of (a) comprises one or more multicistronic element(s). In some embodiments, the multicistronic element(s) is positioned between the nucleic acid sequence encoding the TCRα or a portion thereof and the nucleic acid sequence encoding the TCRβ or a portion thereof. In some embodiments, the one or more multicistronic element(s) are upstream of the nucleic acid sequence encoding the TCR or a portion of the TCR or the nucleic acid molecule encoding the TCR. In some embodiments, the one or more multicistronic element is or comprises a ribosome skip sequence, optionally wherein the ribosome skip sequence is a T2A, a P2A, an E2A, or an F2A element.

In some embodiments of any of the provided polynucleotides, the nucleic acid sequence of (a) comprises one or more heterologous or regulatory control element(s) operably linked to control expression of the TCR when expressed from a cell introduced with the polynucleotide. In some embodiments, the one or more heterologous regulatory or control element comprises a promoter, an enhancer, an intron, a polyadenylation signal, a Kozak consensus sequence, a splice acceptor sequence and/or a splice donor sequence. In some embodiments, the heterologous regulatory or control element comprises heterologous promoter, optionally a human elongation factor 1 alpha (EF1α) promoter or an MND promoter or a variant thereof.

In some embodiments, the provided polynucleotide is a linear polynucleotide, optionally a double-stranded polynucleotide or a single-stranded polynucleotide.

Also provided herein are vectors containing any of the nucleic acid molecules described herein or any of the polynucleotides described herein. In some embodiments, the vector is an expression vector. In some embodiments, the vector is a viral vector. In some embodiments, the viral vector is a retroviral vector. In some embodiments, the viral vector is a lentiviral vector. In some embodiments, the lentiviral vector is derived from HIV-1. In some embodiments of any of the provided vector, the viral vector is an AAV vector. In some embodiments, the AAV vector is selected from among AAV1, AAV2, AAV3, AAV4, AAV5, AAV6, AAV7 or AAV8 vector.

Also provided herein are engineered cells. In some embodiments, the provided engineered cells contain any of the nucleic acid molecules provided herein, any of the polynucleotides provided herein or any of the vectors provided herein.

Also provided herein are engineered cells. In some embodiments, the provided engineered cells contain any of the TCR or antigen-binding fragment thereof described herein.

In some embodiments, the provided engineered cells contain a genetic disruption of a T cell receptor alpha constant (TRAC) gene and/or a T cell receptor beta constant (TRBC) gene. In some embodiments, the TRBC gene is one or both of a T cell receptor beta constant 1 (TRBC1) or T cell receptor beta constant 2 (TRBC2) gene.

Also provided herein are engineered cells containing a TCR or antigen-binding fragment thereof, optionally a recombinant TCR or antigen-binding fragment thereof, wherein: (1) the cell comprises a genetic disruption of a T cell receptor alpha constant region (TRAC) gene and/or a T cell receptor beta constant region (TRBC) gene and/or does not express, or does not express at a detectable level, or expresses less than 20%, 15%, 10%, 5%, 4%, 3%, 2%, or 1% of a wild-type level, a gene product of an endogenous TRAC or TRBC; and (2) the TCR or antigen-binding fragment thereof, or the recombinant TCR or antigen-binding fragment thereof, comprises any one of the TCR or antigen-binding fragment thereof provided herein, optionally a recombinant TCR or antigen-binding fragment. In some embodiments, the engineered cell comprises a genetic disruption of a T cell receptor alpha constant (TRAC) locus.

In some embodiments of any of the provided engineered cells, the endogenous TRAC locus is further modified by integration of a nucleic acid sequence encoding any one of the TCR or an antigen-binding fragment thereof at the TRAC locus, optionally via homology directed repair (HDR). In some embodiments, the endogenous TRAC locus is further modified by integration of a transgene sequence encoding a portion of the TCR or an antigen-binding fragment thereof, optionally via homology directed repair (HDR).

Also provided herein is an engineered cell comprising a modified TRAC locus encoding any one of the TCR or an antigen-binding fragment thereof provided herein.

Also provided herein is an engineered cell comprising a modified TRAC locus, wherein the endogenous TRAC locus is modified by integration of a transgene sequence encoding a portion of the TCR, said transgene sequence encoding (i) a T cell receptor beta (TCRβ) chain comprising a variable beta (Vβ) of any one of the TCR or antigen-binding fragment thereof and a constant beta (Cβ); and (ii) a portion of a T cell receptor alpha (TCRα) chain comprising a variable alpha (Vα) of the any one of the TCR or antigen-binding fragment thereof, wherein at least a portion of the constant alpha (Cα) of the TCR is encoded by the open reading frame of the endogenous TRAC locus or a partial sequence thereof.

In some of any embodiments of the provided engineered cells, the TCR or an antigen-binding fragment thereof comprises a Cα, at least a portion of said Cα is encoded by an open reading frame or a partial sequence thereof of the endogenous TRAC locus. In some embodiments, the modified TRAC locus comprises an in-frame fusion of (i) a transgene sequence encoding a portion of the TCR and (ii) an open reading frame or a partial sequence thereof of the endogenous TRAC locus. In some embodiments, the transgene sequence does not comprise a sequence encoding a 3' UTR or an intron. In some embodiments, the open reading frame or a partial sequence thereof comprises a 3' UTR of the endogenous TRAC locus.

In some of any embodiments of the provided engineered cells, the transgene sequence is integrated downstream of the most 5' nucleotide of exon 1 and upstream of the most 3' nucleotide of exon 1 of the open reading frame of the endogenous TRAC locus. In some embodiments, the at least a portion of Cα is encoded by at least exons 2-4 of the open reading frame of the endogenous TRAC locus. In some embodiments, the at least a portion Cα is encoded by at least a portion of exon 1 and exons 2-4 of the open reading frame of the endogenous TRAC locus.

In some embodiments of any of the provided engineered cells, the transgene sequence encodes a T cell receptor beta (TCRβ) chain and/or a TCR alpha variable region (Vα).

In some embodiments of any of the provided engineered cells, the engineered cell further comprises a genetic disruption of a T cell receptor beta constant region (TRBC) locus, optionally a TRBC1 or a TRBC2 locus.

In some embodiments of any of the provided engineered cells, the engineered cell comprises a genetic disruption of a T cell receptor beta constant (TRBC) locus. In some embodiments, the endogenous TRBC locus is further modified by integration of a nucleic acid sequence encoding the TCR or an antigen-binding fragment thereof at the TRBC locus, optionally via HDR. In some embodiments, the endogenous TRBC locus is further modified by integration of a transgene sequence encoding a portion of the TCR or an antigen-binding fragment thereof, optionally via homology directed repair (HDR).

Provided herein is an engineered cell containing a modified TRBC locus encoding any one of the TCR or an antigen-binding fragment thereof.

Provided herein is an engineered cell containing a modified TRBC locus, wherein the endogenous TRBC locus is modified by integration of a transgene sequence encoding a portion of the TCR, said transgene sequence encoding (i) a T cell receptor alpha (TCRα) chain comprising a variable alpha (Vα) of any one of the TCR or antigen-binding fragment thereof and a constant alpha (Cα); and (ii) a portion of a T cell receptor beta (TCRβ) chain comprising a variable beta (Vβ) of the any one of the TCR or antigen-binding fragment thereof, wherein at least a portion of the constant beta (Cβ) of the TCR is encoded by the open reading frame of the endogenous TRBC locus or a partial sequence thereof.

In some embodiments of any of the provided engineered cells, the TCR or an antigen-binding fragment thereof comprises a Cβ, at least a portion of said Cβ is encoded by an open reading frame or a partial sequence thereof of the endogenous TRBC locus. In some embodiments, the modified TRBC locus comprises an in-frame fusion of (i) a transgene sequence encoding a portion of the TCR and (ii) an open reading frame or a partial sequence thereof of the endogenous TRBC locus. In some embodiments, the transgene sequence does not comprise a sequence encoding a 3' UTR or an intron. In some embodiments, the open reading frame or a partial sequence thereof comprises a 3' UTR of the endogenous TRBC locus. In some embodiments, the transgene sequence is integrated downstream of the most 5' nucleotide of exon 1 and upstream of the most 3' nucleotide of exon 1 of the open reading frame of the endogenous TRBC locus. In some embodiments, the at least a portion of Cβ is encoded by at least exons 2-4 of the open reading frame of the endogenous TRBC locus. In some embodiments, the at least a portion of Cβ is encoded by at least a portion of exon 1 and exons 2-4 of the open reading frame of the endogenous TRBC locus.

In some embodiments of any of the provided engineered cells, the transgene sequence encodes a T cell receptor alpha (TCRα) chain and/or a TCR beta variable region (Vβ).

In some embodiments of any of the provided engineered cells, the TRBC locus is one or both of a T cell receptor beta constant 1 (TRBC1) or T cell receptor beta constant 2 (TRBC2) locus. In some embodiments, the engineered cell further comprises a genetic disruption of a T cell receptor alpha constant region (TRAC) locus.

In some embodiments of any of the provided engineered cells, the transgene sequence or the nucleic acid sequence encoding the TCR or an antigen-binding fragment thereof comprises one or more multicistronic element(s). In some embodiments, the one or more multicistronic element(s) are upstream of the transgene sequence or the nucleic acid sequence encoding the TCR or an antigen-binding fragment thereof. In some embodiments, the multicistronic element(s) is positioned between the nucleic acid sequence encoding the TCRα or a portion thereof and the nucleic acid sequence encoding the TCRβ or a portion thereof. In some embodiments, the one or more multicistronic element is or comprises a ribosome skip sequence, optionally wherein the ribosome skip sequence is a T2A, a P2A, an E2A, or an F2A element.

In some embodiments of any of the provided engineered cells, the transgene sequence or the nucleic acid sequence encoding the TCR or an antigen-binding fragment thereof comprises one or more heterologous or regulatory control element(s) operably linked to control expression of the TCR when expressed from a cell introduced with the engineered cell. In some embodiments, the one or more heterologous regulatory or control element comprises a promoter, an enhancer, an intron, a polyadenylation signal, a Kozak consensus sequence, a splice acceptor sequence and/or a splice donor sequence. In some embodiments, the heterologous regulatory or control element comprises heterologous promoter, optionally a human elongation factor 1 alpha (EF1α) promoter or an MND promoter or a variant thereof.

In some embodiments of any of the provided engineered cells, the TCR or antigen-binding fragment thereof is heterologous to the cell. In some embodiments, the engineered cell is a cell line. In some embodiments, the engineered cell is a primary cell obtained from a subject. In some embodiments, the subject is a mammalian subject. In some embodiments, the subject is a human. In some embodiments, the engineered cell is a T cell. In some embodiments, the T cell is CD8+. In some embodiments, the T cell is CD4+.

Also provided herein are methods for producing any of the engineered cells described herein, that includes introducing any of the vectors described herein into a cell in vitro or ex vivo. In some embodiments, the vector is a viral vector and the introducing is carried out by transduction.

Also provided herein is a method for producing a cell, comprising introducing a nucleic acid molecule encoding any one of the TCR or antigen-binding fragment thereof provided herein, any one of the nucleic acid molecule provided herein, any one of the polynucleotide provided herein, or any one of the vector provided herein into a cell in vitro or ex vivo.

In some embodiments, the methods provided herein include introducing into the cell one or more agent, wherein each of the one or more agent is independently capable of inducing a genetic disruption of a T cell receptor alpha constant (TRAC) gene and/or a T cell receptor beta constant (TRBC) gene. In some embodiments, the one or more agent capable of inducing a genetic disruption comprises a DNA binding protein or DNA-binding nucleic acid that specifically binds to or hybridizes to the target site. In some embodiments, the one or more agent capable of inducing a genetic disruption comprises (a) a fusion protein containing a DNA-targeting protein and a nuclease or (b) an RNA-guided nuclease. In some embodiments, the DNA-targeting protein or RNA-guided nuclease comprises a zinc finger protein (ZFP), a TAL protein, or a clustered regularly interspaced short palindromic nucleic acid (CRISPR)-associated nuclease (Cas) specific for a target site within the TRAC and/or TRBC gene. In some embodiments, the one or more agent comprises a zinc finger nuclease (ZFN), a TAL-effector nuclease (TALEN), or and a CRISPR-Cas9 combination that specifically binds to, recognizes, or hybridizes to the target site. In some embodiments, the each of the one or more agent comprises a guide RNA (gRNA) having a targeting domain that is complementary to the at least one target site.

In some embodiments, the one or more agent is introduced as a ribonucleoprotein (RNP) complex containing the gRNA and a Cas9 protein. In some embodiments, the RNP is introduced via electroporation, particle gun, calcium phosphate transfection, cell compression or squeezing. In some embodiments, the RNP is introduced via electroporation.

In some embodiments, the one or more agent is introduced as one or more polynucleotide encoding the gRNA and/or a Cas9 protein.

In some embodiments of any of the provided methods, the one or more agent(s) and the nucleic acid molecule, the polynucleotide or the vector are introduced simultaneously or sequentially, in any order. In some embodiments, the nucleic acid molecule, the polynucleotide or the vector is introduced after the introduction of the one or more agent(s). In some embodiments, the nucleic acid molecule, the polynucleotide or the vector is introduced immediately after, or within about 30 seconds, 1 minute, 2 minutes, 3 minutes, 4 minutes, 5 minutes, 6 minutes, 6 minutes, 8 minutes, 9 minutes, 10 minutes, 15 minutes, 20 minutes, 30 minutes, 40 minutes, 50 minutes, 60 minutes, 90 minutes, 2 hours, 3 hours or 4 hours after the introduction of the agent.

Also provided herein are compositions. In some embodiments, the compositions contain any of the engineered cells described herein. In some embodiments, the engineered cells comprise CD4+ and/or CD8+ T cells. In some embodiments, the engineered cells comprise CD4+ and CD8+ T cells.

Also provided herein are compositions. In some embodiments, the compositions contain any engineered CD8+ cells and any engineered CD4+ cells described herein.

In some embodiments, the TCR or antigen-binding fragment thereof binds to or recognizes a peptide epitope of HPV 16 in the context of an MHC molecule that is at least partially CD8-independent. In some embodiments, the CD8+ cell and CD4+ cell are engineered with the same TCR or antigen-binding fragment thereof and/or are each engineered with a TCR or antigen-binding fragment thereof that binds to or recognizes the same peptide epitope of HPV 16 in the context of an MHC molecule.

In some embodiments, any of the compositions provided herein also contain a pharmaceutically acceptable excipient.

Also provided herein are methods of treatment. In some embodiments, the provided methods of treatment include administering any of the engineered cells described herein to a subject having a disease or disorder associated with HPV.

Also provided herein are methods of treatment. In some embodiments, the provided methods of treatment include administering any of the composition described herein to a subject having a disease or disorder associated with HPV. In some embodiments, the disease or disorder is associated with HPV16. In some embodiments, the disease or disorder is cancer. In some embodiments, the subject is a human.

Also provided herein are compositions, such as any of the compositions described herein, for use in treating a disease or disorder associated with HPV.

Also provided herein are uses of compositions, such as any of the compositions provided herein, for the manufacture of a medicament for treating a disease or disorder associated with HPV. In some embodiments, the disease or disorder is associated with HPV16. In some embodiments, the disease or disorder is cancer. In some embodiments, the subject is a human.

BRIEF DESCRIPTION OF THE DRAWINGS

FIGS. 5A-5C show flow cytometry results for tetramer binding and in Jurkat-derived cell line that also expresses exogenous CD8 and various E6(29-38)-specific TCRs, in CD8+ cells. Results are shown for TCR 9, TCR13, TCR14, a reference TCR capable of binding to HLA-A2/E6(29-38) (Reference TCR) and cells that had been mock transfected (mock) (FIG. 5A); TCR 17, TCR 21, TCR 22, Reference TCR and Mock (FIG. 5B); and TCR 18, TCR 23, TCR 24 and TCR 27 (FIG. 5C).

FIGS. 5D-5F show flow cytometry results for tetramer binding and in Jurkat-derived cell line that also expresses exogenous CD8 and various E6(29-38)-specific TCRs. Results are shown for TCR 15, TCR 16, TCR 17, TCR 19, TCR 20 and TCR 21 (FIG. 5D); TCR 18, TCR 23, TCR 24, TCR 27 and TCR 28 (FIG. 5E); and TCR 25, TCR 26, TCR 29 and TCR 30 (FIG. 5F).

FIGS. 6A-6G show flow cytometry results for tetramer binding and in Jurkat-derived cell line that also expresses exogenous CD8 and various E7(11-19)-specific TCRs. Results are shown for TCR 12 and cells that had been mock transfected (mock) (FIG. 6A); TCR 31, TCR 32, TCR 33 and TCR 34 (FIG. 6B); TCR 12, TCR 49, TCR 50 and TCR 51 (FIG. 6C); TCR 35, TCR 36, TCR 37, TCR 38, TCR 53 and TCR 54 (FIG. 6D); TCR 39, TCR 40, TCR 41, TCR 42, TCR 43 and TCR 44 (FIG. 6E); and TCR 45, TCR 46, TCR 47, TCR 48, TCR 54 and TCR 55 (FIG. 6F). FIG. 6G shows corresponding flow cytometry results for tetramer binding in cells that are engineered to express recombinant TCRs that were observed to show CD8-dependent tetramer binding (left, TCR49) or CD8-independent tetramer binding (right, TCR37).

FIG. 9A (TCR 49), FIG. 9D (TCR 53) and FIG. 9G (TCR 37) show the expression of the TCRs, as assessed by E7(11-19) tetramer binding. FIG. 9B (TCR 49), FIG. 9E (TCR 53), FIG. 9I (TCR 37) and FIG. 9J (TCR 37) show cytolytic activity, as monitored by decreased NucRed light signal. FIG. 9C (TCR 49), FIG. 9F (TCR 53), FIG. 9I (TCR 37) and FIG. 9J (TCR 37), show interferon-gamma production by TCR-expressing cells following incubation with antigen-specific target cells.

FIG. 12B-12C shows assessment of cytolytic activity and interferon gamma cytokine production of the exemplary TCRs in cells with knock-out of the endogenous TCR genes compared to in cells that retained the endogenous TCR genes.

FIGS. 14A-14G are representations of several exemplary gRNAs.

FIG. 14A depicts a modular gRNA molecule derived in part (or modeled on a sequence in part) from *Streptococcus pyogenes* (*S. pyogenes*) as a duplexed structure (SEQ ID NO:42 and 43 of International PCT Pub. No. WO2015161276, respectively, in order of appearance);

FIG. 14B depicts a unimolecular (or chimeric) gRNA molecule derived in part from *S. pyogenes* as a duplexed structure (SEQ ID NO:44 of International PCT Pub. No. WO2015161276);

FIG. 14C depicts a unimolecular gRNA molecule derived in part from *S. pyogenes* as a duplexed structure (SEQ ID NO:45 of International PCT Pub. No. WO2015161276);

FIG. 14D depicts a unimolecular gRNA molecule derived in part from *S. pyogenes* as a duplexed structure (SEQ ID NO:46 of International PCT Pub. No. WO2015161276);

FIG. 14E depicts a unimolecular gRNA molecule derived in part from *S. pyogenes* as a duplexed structure (SEQ ID NO:47 of International PCT Pub. No. WO2015161276);

FIG. 14F depicts a modular gRNA molecule derived in part from *Streptococcus thermophilus* (*S. thermophilus*) as a duplexed structure (SEQ ID NO:48 and 49 of International PCT Pub. No. WO2015161276, respectively, in order of appearance);

FIG. 14G depicts an alignment of modular gRNA molecules of *S. pyogenes* and *S. thermophiles* (SEQ ID NO:50-53 of International PCT Pub. No. WO2015161276, respectively, in order of appearance).

Figure 15C:
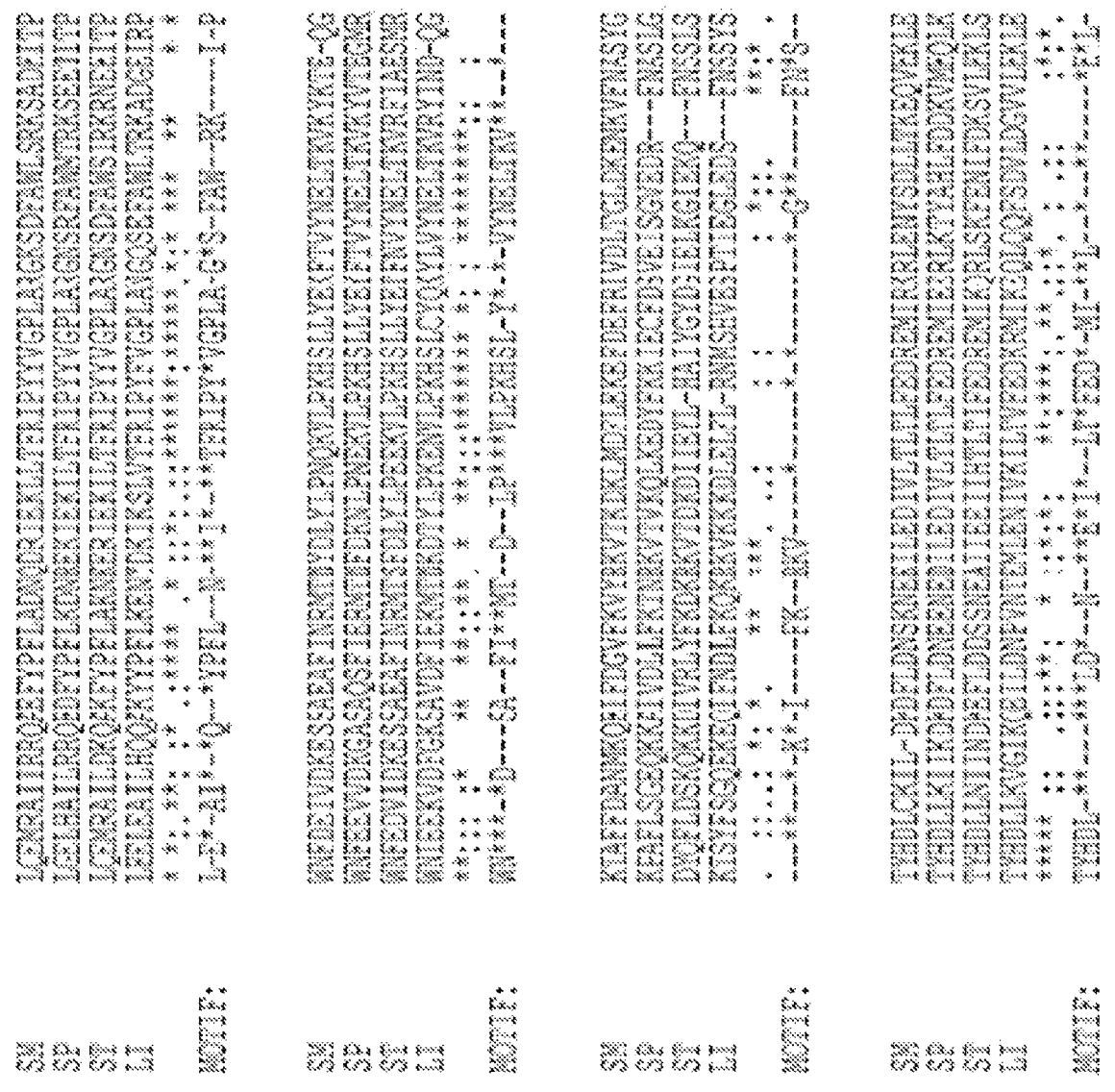

FIGS. 15A-15G depict an alignment of Cas9 sequences from Chylinski et al. (RNA Biol. 2013; 10(5): 726-737). The N-terminal RuvC-like domain is boxed and indicated with a "y". The other two RuvC-like domains are boxed and indicated with a "b". The HNH-like domain is boxed and indicated by a "g". Sm: *S. mutans* (SEQ ID NO:1331); Sp: *S. pyogenes* (SEQ ID NO:1332); St: *S. thermophilus* (SEQ ID NO:1333); Li: *L. innocua* (SEQ ID NO:1334). Motif: this is a motif based on the four sequences: residues conserved in all four sequences are indicated by single letter amino acid abbreviation; "*" indicates any amino acid found in the corresponding position of any of the four sequences; and "-" indicates any amino acid, e.g., any of the 20 naturally occurring amino acids.

FIGS. 16A-16C depict an alignment of Cas9 sequences from *S. pyogenes* and *Neisseria meningitides* (*N. meningiti-* dis). The N-terminal RuvC-like domain is boxed and indicated with a "Y". The other two RuvC-like domains are boxed and indicated with a "B". The HNH-like domain is boxed and indicated with a "G". Sp: *S. pyogenes*; Nm: *N. meningitidis*. Motif: this is a motif based on the two sequences: residues conserved in both sequences are indicated by a single amino acid designation; "*" indicates any amino acid found in the corresponding position of any of the two sequences; "-" indicates any amino acid, e.g., any of the 20 naturally occurring amino acids, and "-" indicates any amino acid, e.g., any of the 20 naturally occurring amino acids, or absent.

Figure 17A:
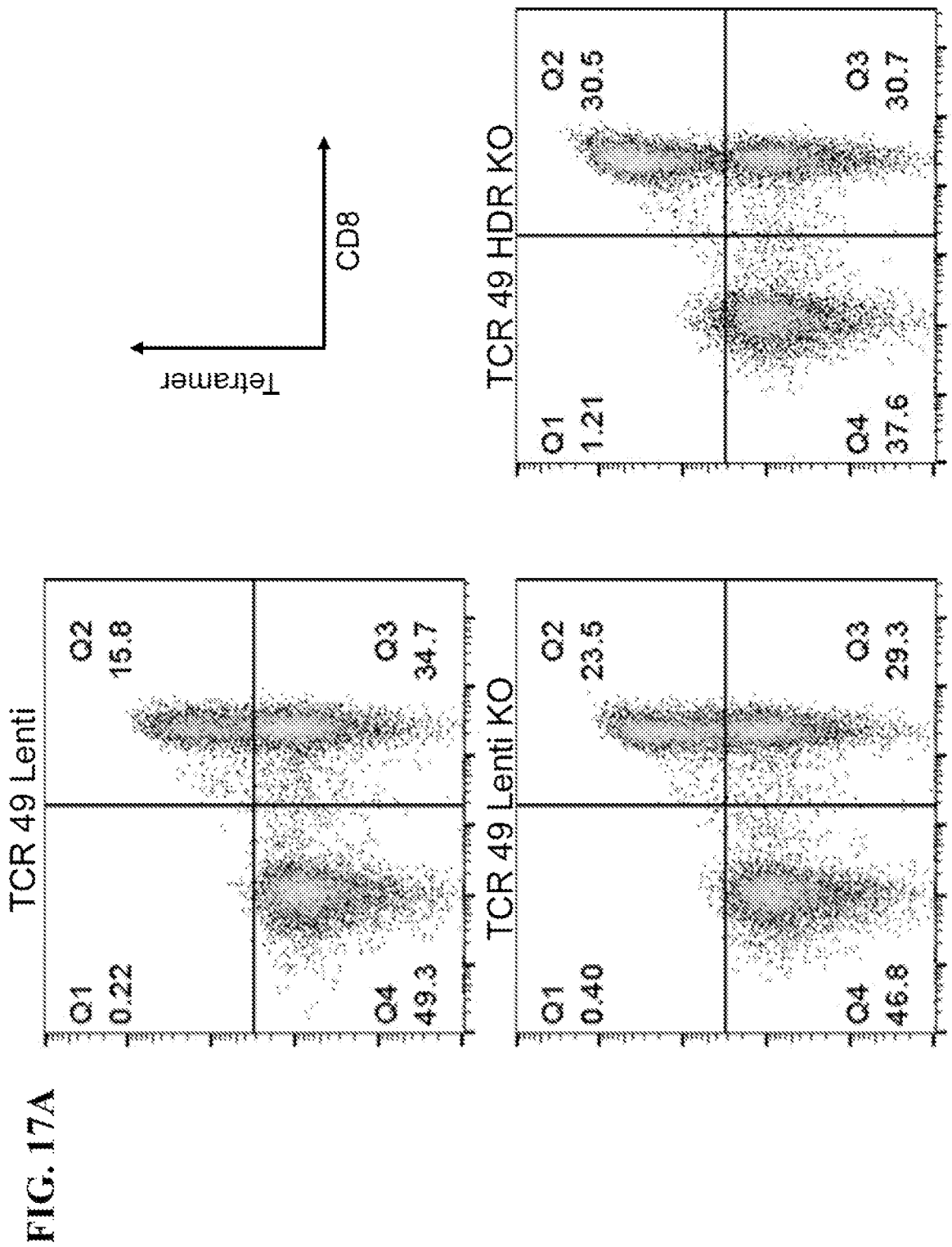

FIG. 17A depicts surface expression of CD8 and peptide-MHC tetramer complexed with the antigen recognized by an exemplary recombinant TCR (TCR 49), as assessed by flow cytometry, for T cells subject to knockout of endogenous TCR encoding genes, engineered to express TCR 49 using various methods of expression: cells subject to lentiviral transduction for random integration of the recombinant TCR-encoding sequences ("TCR 49 Lenti"), cells subject to random integration and CRISPR/Cas9 mediated knockout (KO) of TRAC ("TCR 49 Lenti KO"); or cells subject to targeted integration by HDR at the TRAC locus of the recombinant TCR-encoding sequences, under the control of the human EF1α promoter (TCR 49 HDR KO). FIGS. 17B and 17C depict the mean fluorescence intensity (MFI; FIG. 17B) and the coefficient of variation (the standard deviation of signal within a population of cells divided by the mean of the signal in the respective population; FIG. 17C) of cell surface expression of binding of the peptide-MHC tetramer in CD8+ T cells engineered to express TCR 49.

Figure 18A:
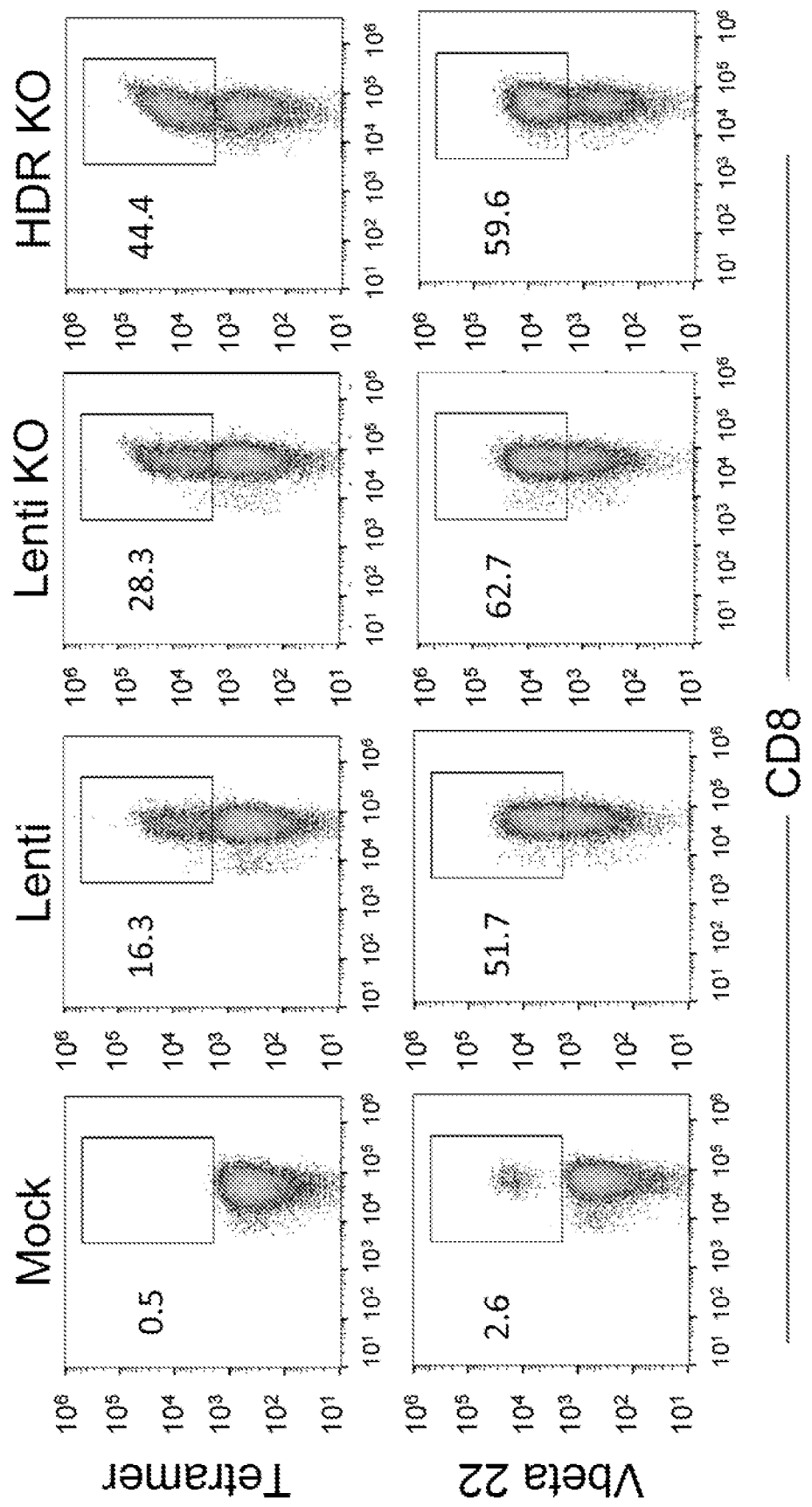
Figure 18B:
Figure 18C:
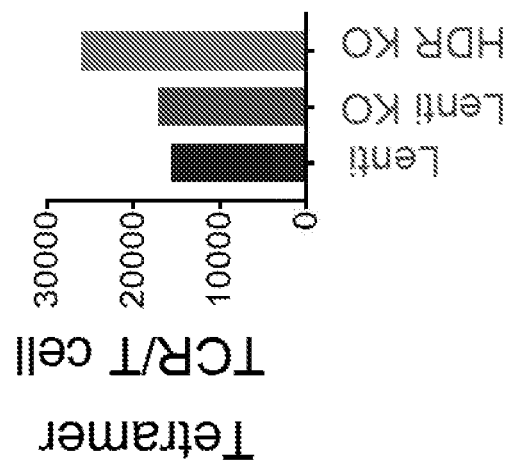

FIG. 18A-18C depicts staining and receptor density for the TCR (TCR 49), using the anti Vbeta22 antibody specific for the recombinant TCR or the peptide-MHC tetramer.

Figure 19:
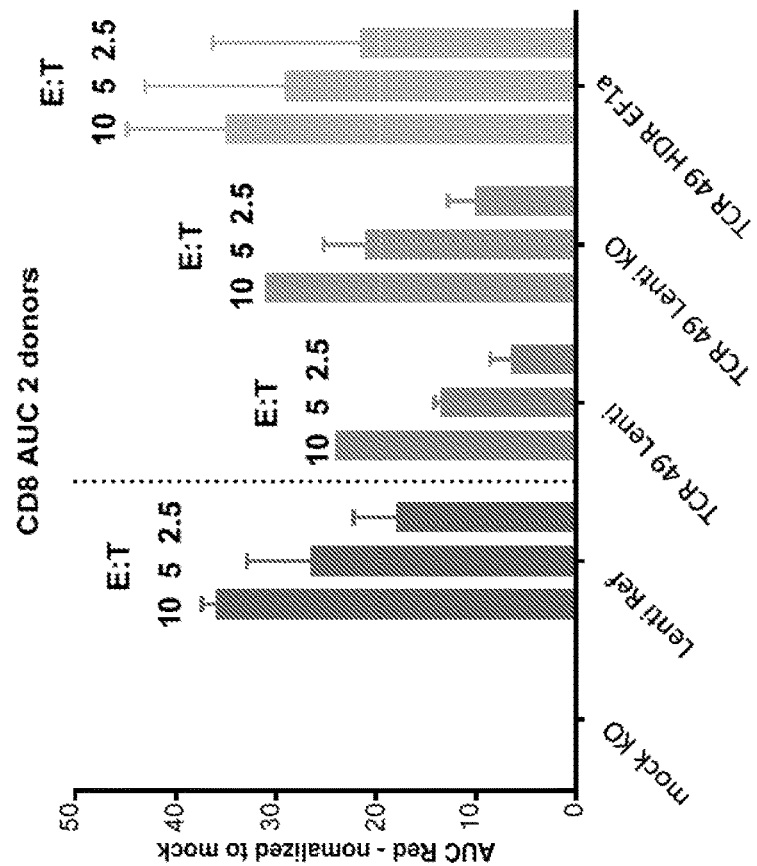

FIG. 19 depicts the average cytolytic activity of the various recombinant TCR 49-expressing CD8+ T cells as described above generated from 2 donors, represented by the area under the curve (AUC) of % killing, compared to mock transduction control and normalized to Vbeta22 expression (recombinant TCR-specific staining) for each group described above, after incubation of the effector cells as described above with target cells expressing HPV 16 E7 at an effector to target (E:T) ratio of 10:1, 5:1 and 2.5:1. CD8+ cells transduced with a lentivirus encoding a reference TCR capable of binding to HPV 16 E7 but containing mouse Cα and the Cβ regions was assessed as a control ("Lenti Ref").

Figure 20:
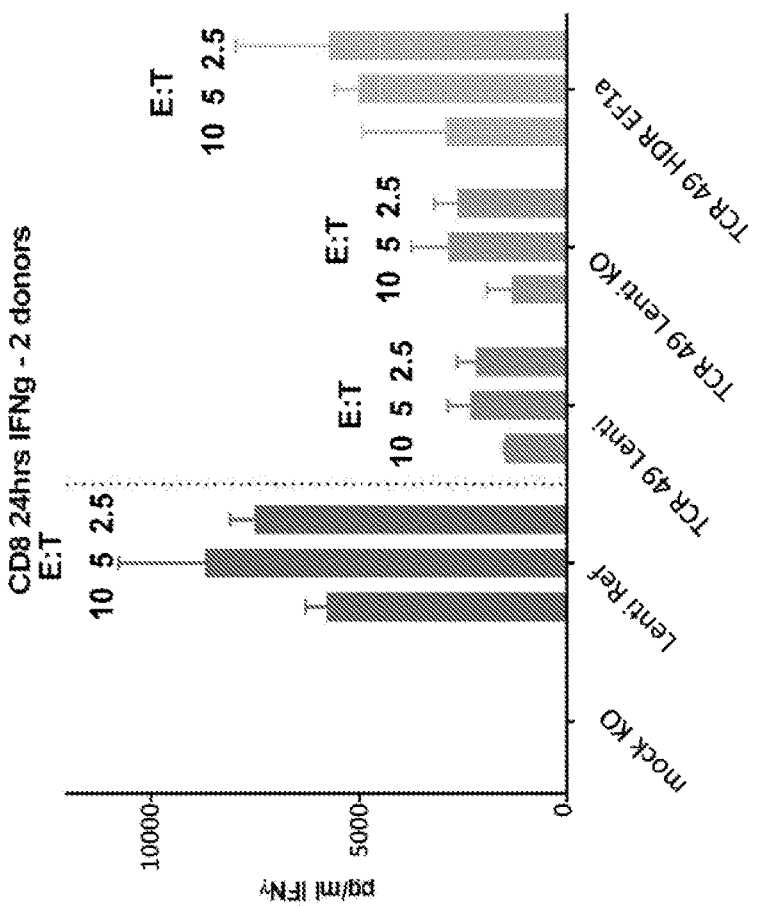

FIG. 20 depicts the average IFNγ secretion (pg/mL) by the various recombinant TCR 49-expressing CD8+ T cells as described above.

Figure 21A:
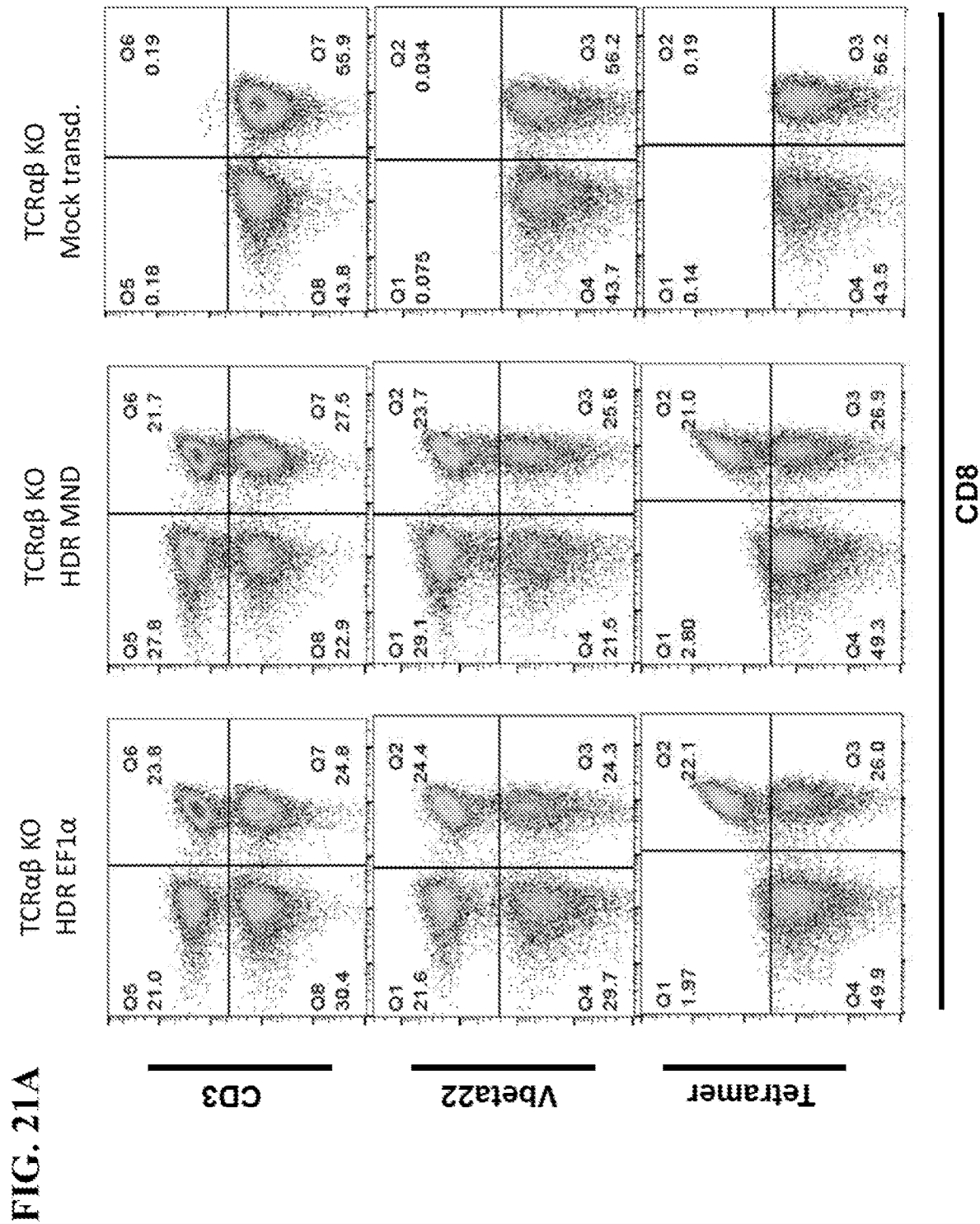
Figure 21B:
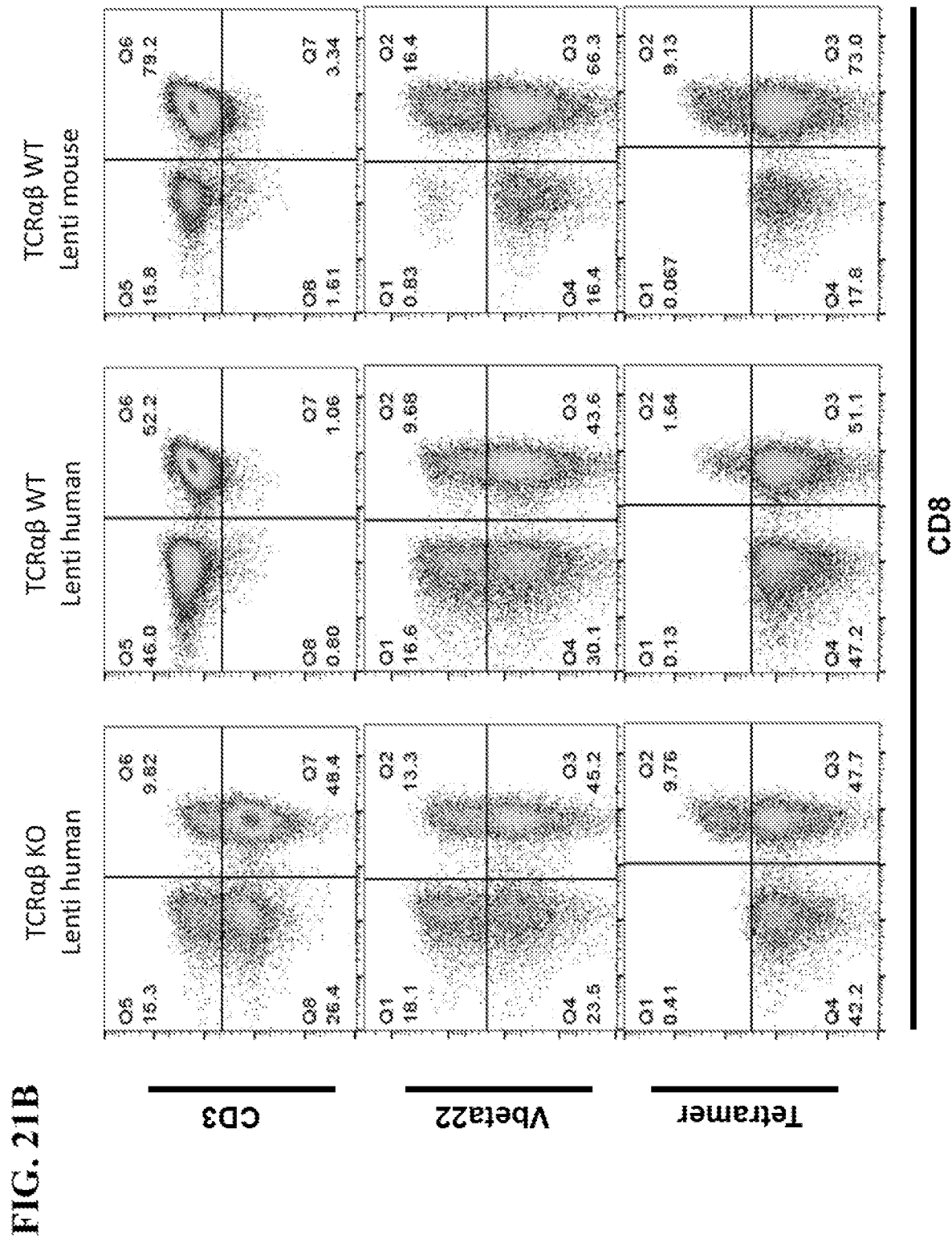

FIGS. 21A and 21B depicts surface expression of CD8, CD3, Vbeta22 (recombinant TCR-specific staining) and peptide-MHC tetramer complexed with the antigen recognized by the recombinant TCR, as assessed by flow cytometry, for T cells subject to knockout of endogenous TCR encoding genes, engineered to express a recombinant T cell receptor (TCR) using various methods of expression: cells subject to CRISPR/Cas9 mediated knockout (KO) of TRAC and TRBC ("TCRαβ KO") or retaining expression of the endogenous TCR ("TCRαβ WT"); cells subject to targeted integration by HDR at the TRAC locus of the recombinant TCR-encoding sequences linked to the EF1α or MND promoter ("HDR EF1α" or "HDR MND"); cells subject to lentiviral transduction for random integration of the recombinant TCR-encoding sequences ("lenti human"), or of the recombinant TCR-encoding sequences containing a mouse constant domain ("lenti mouse"), or mock transduction as control ("mock transd").

Figure 21D:
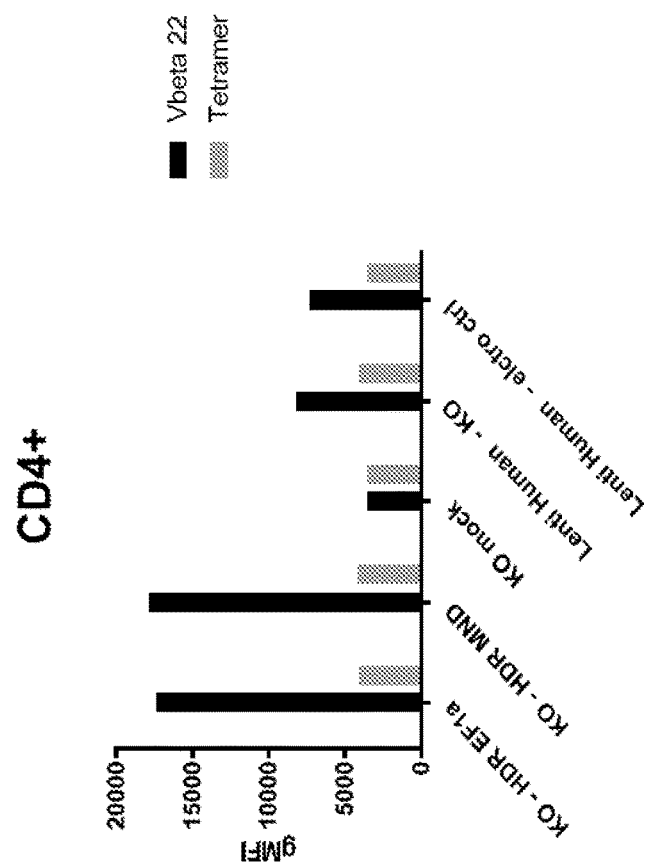
Figure 21C:
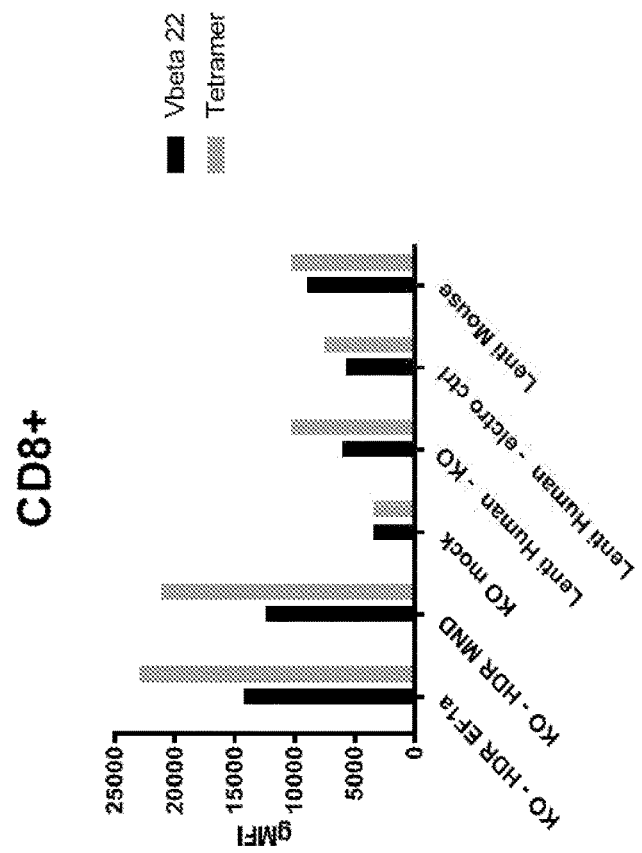

FIGS. 21C and 21D depict the geometric mean fluorescence intensity (gMFI) of cell surface expression of Vbeta22 and binding of the peptide-MHC tetramer in CD8+(FIG. 21C) or CD4+(FIG. 21D) T cells engineered to express a recombinant T cell receptor (TCR) using various methods of expression as described above.

Figure 21E:
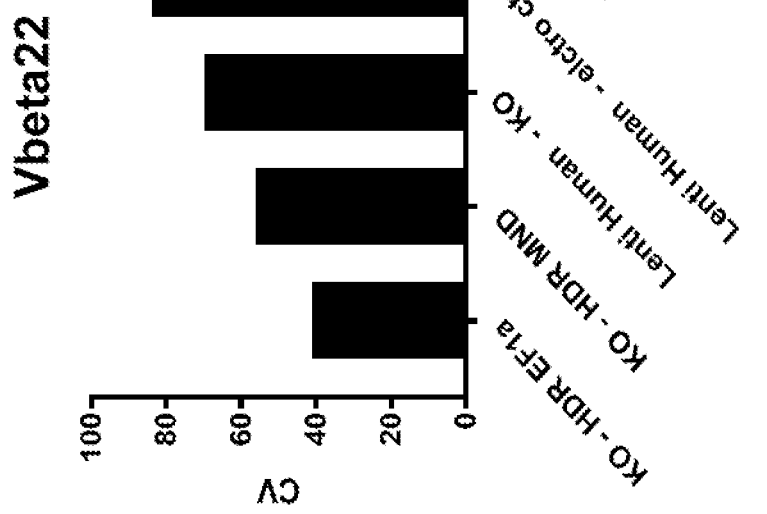
Figure 21F:
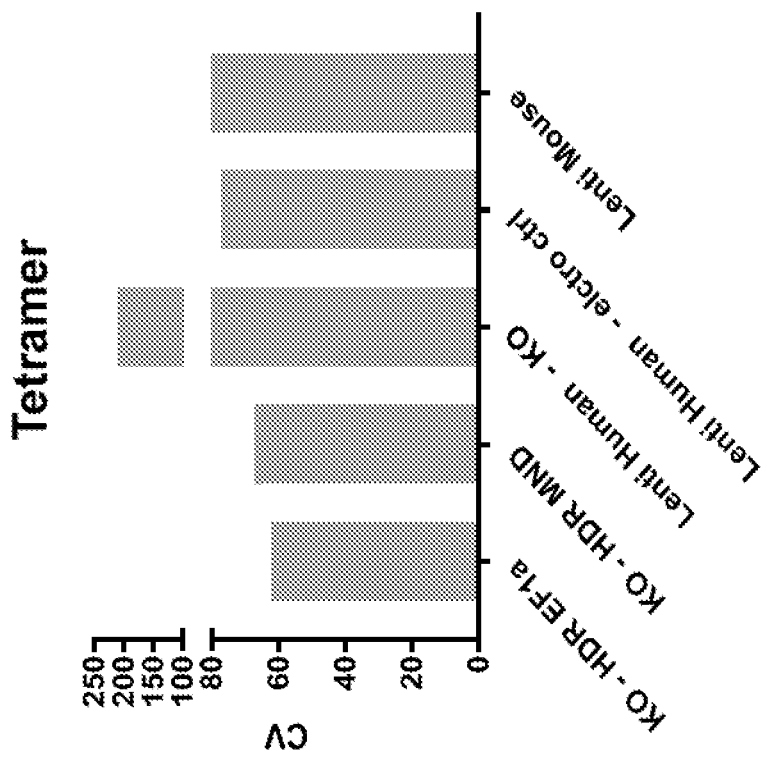

FIGS. 21E and 21F show the coefficient of variation (the standard deviation of signal within a population of cells divided by the mean of the signal in the respective population) in CD8+ T cells engineered to express a recombinant T cell receptor (TCR) using various methods of expression as described above, for expression of the peptide-MHC tetramer (FIG. 21E) and binding of Vbeta22 (FIG. 21F).

Figure 22C:
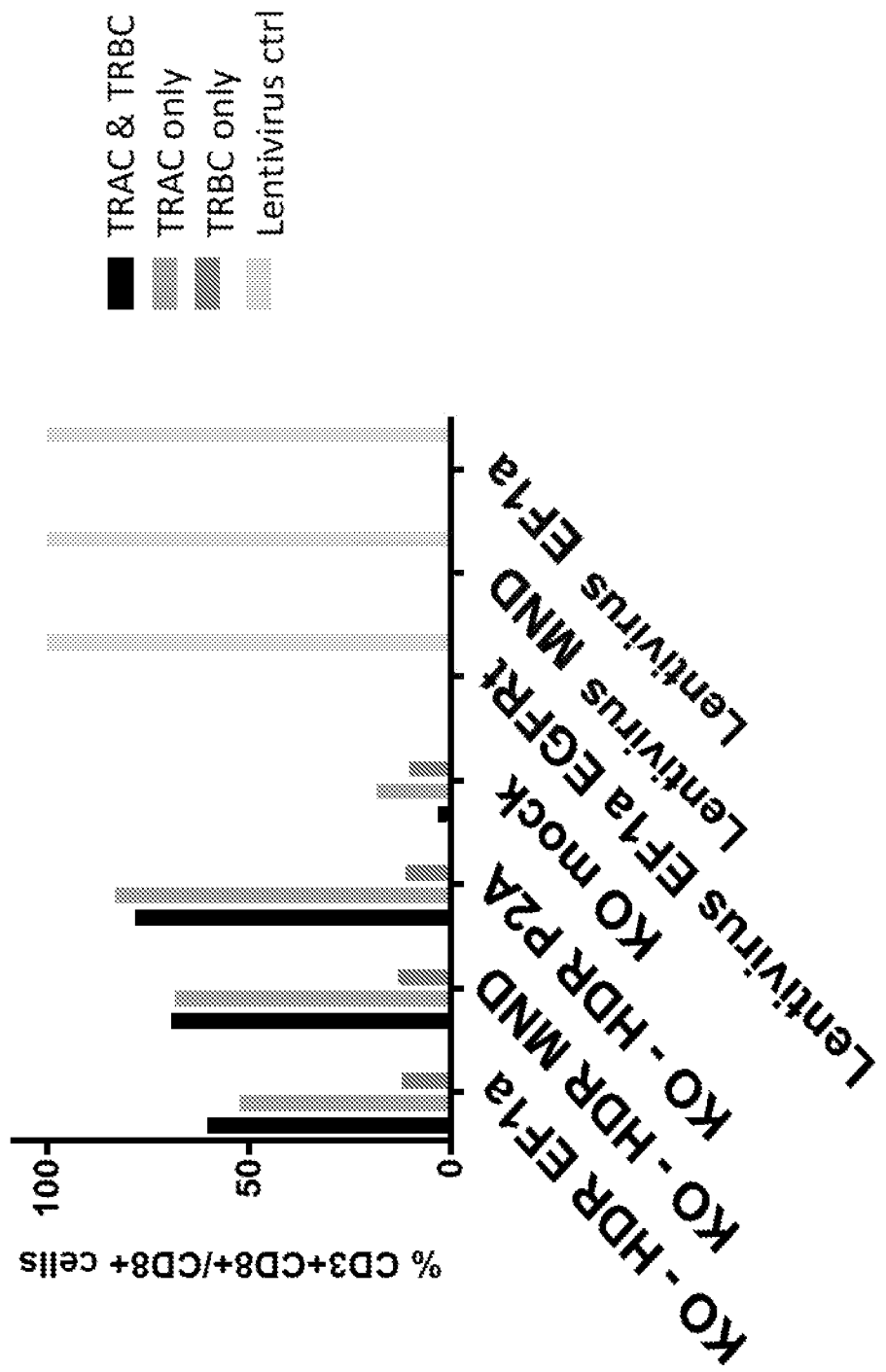

FIGS. 22A-22C depict surface expression of CD3 and CD8, as assessed by flow cytometry, for T cells subject to knockout of endogenous TCR encoding genes, engineered to express a recombinant T cell receptor (TCR) using various methods of expression: cells subject to CRISPR/Cas9 mediated knockout (KO) of TRAC, TRBC or both TRAC and TRBC; cells subject to targeted integration by HDR at the TRAC locus of the recombinant TCR-encoding sequences linked to the EF1α promoter, MND promoter or endogenous TCR alpha promoter using a P2A ribosome skip sequence ("HDR EF1α," "HDR MND" or "HDR P2A," respectively) or cells subject to mock transduction as control ("mock transd") (FIG. 22A); cells retaining expression of the endogenous TCR and subject to lentiviral transduction for random integration of the recombinant TCR-encoding sequences linked to the EF1α promoter ("lenti EF1α") or MND promoter ("lenti MND"), or linked to EF1α promoter with sequences encoding the truncated receptor as a surrogate marker ("lenti EF1α/tReceptor"), or subject to mock transduction as a control ("mock") (FIG. 22B). FIG. 22C depicts the percentage of CD3+CD8+ cells among CD8+ cells in each of the groups described above.

Figure 23A:
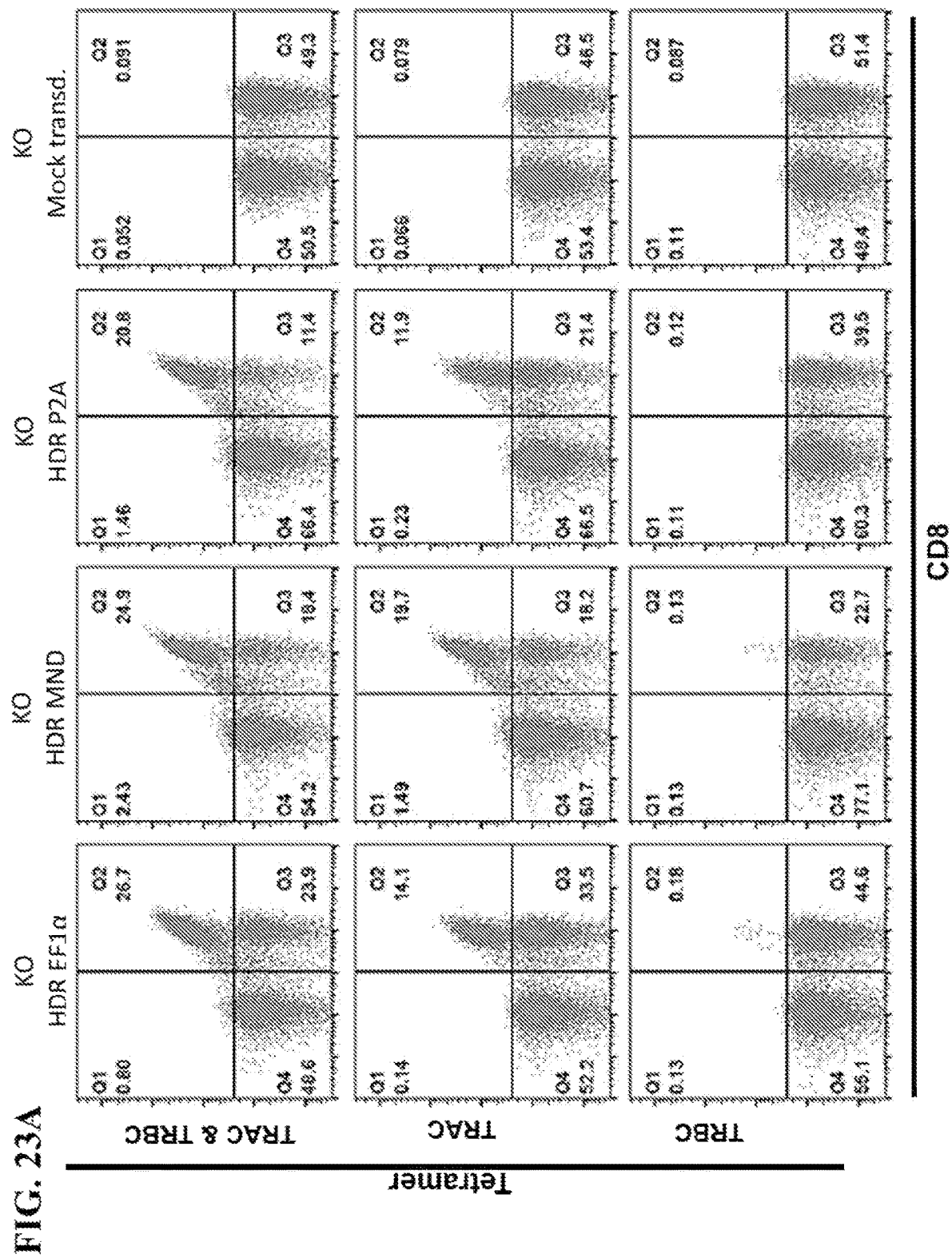
Figure 23B:
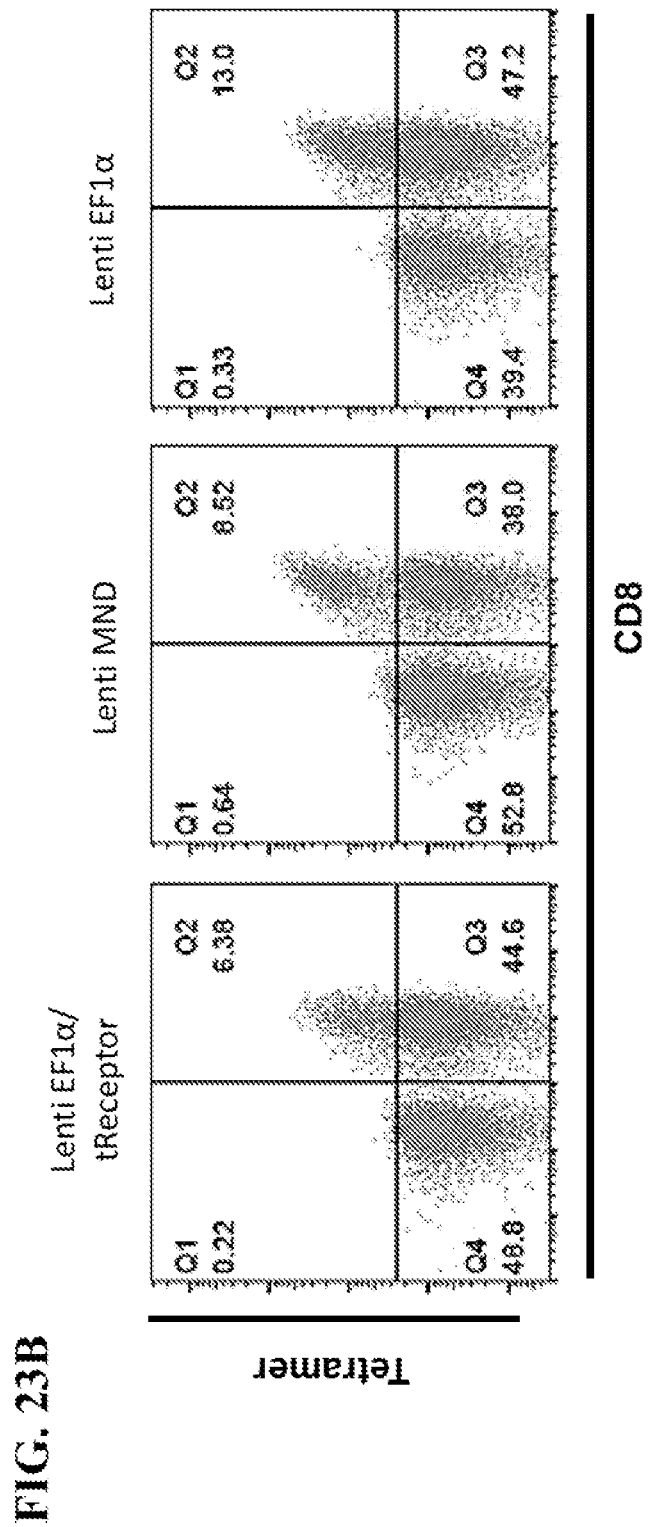
Figure 23C:
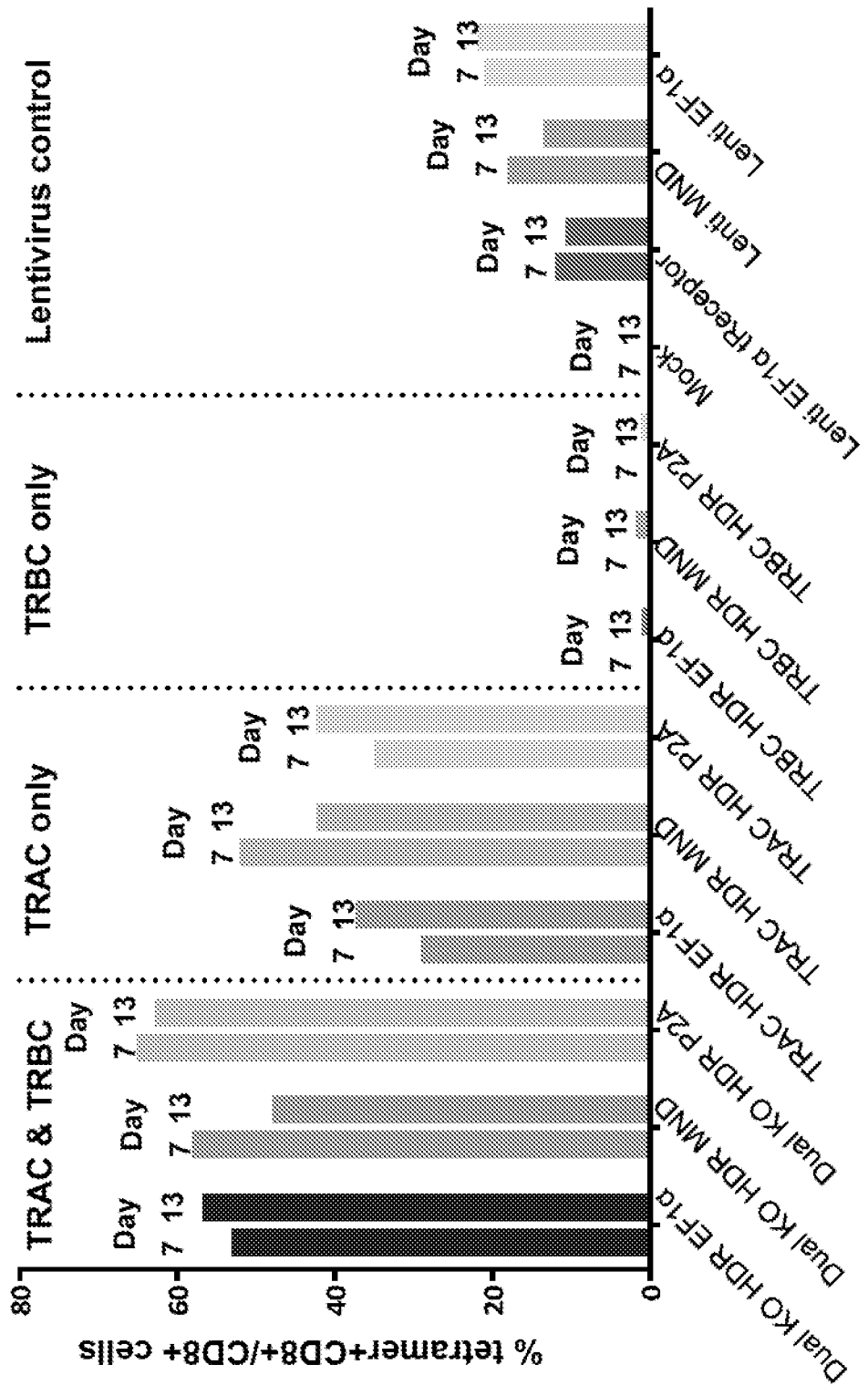

FIGS. 23A-23C depict binding of the peptide-MHC tetramer and surface expression of CD8, as assessed by flow cytometry, for T cells subject to knockout of endogenous TCR encoding genes, engineered to express a recombinant T cell receptor (TCR) using various methods of expression: cells subject to CRISPR/Cas9 mediated knockout (KO) of TRAC, TRBC or both TRAC and TRBC; cells subject to targeted integration by HDR at the TRAC locus of the recombinant TCR-encoding sequences linked to the EF1α promoter, MND promoter or endogenous TCR alpha promoter using a P2A ribosome skip sequence ("HDR EF1α," "HDR MND" or "HDR P2A," respectively) or cells subject to mock transduction as control ("mock transd") (FIG. 23A); cells retaining expression of the endogenous TCR and subject to lentiviral transduction for random integration of the recombinant TCR-encoding sequences linked to the EF1α promoter ("lenti EF1α") or MND promoter ("lenti MND"), or linked to EF1α promoter with sequences encoding a truncated receptor as a surrogate marker ("lenti EF1α/tReceptor"), or subject to mock transduction as a control ("mock") (FIG. 23B). FIG. 23C depicts the percentage of tetramer+CD8+ cells among CD8+ cells in each of the groups described above, on day 7 and day 13.

Figure 24A:
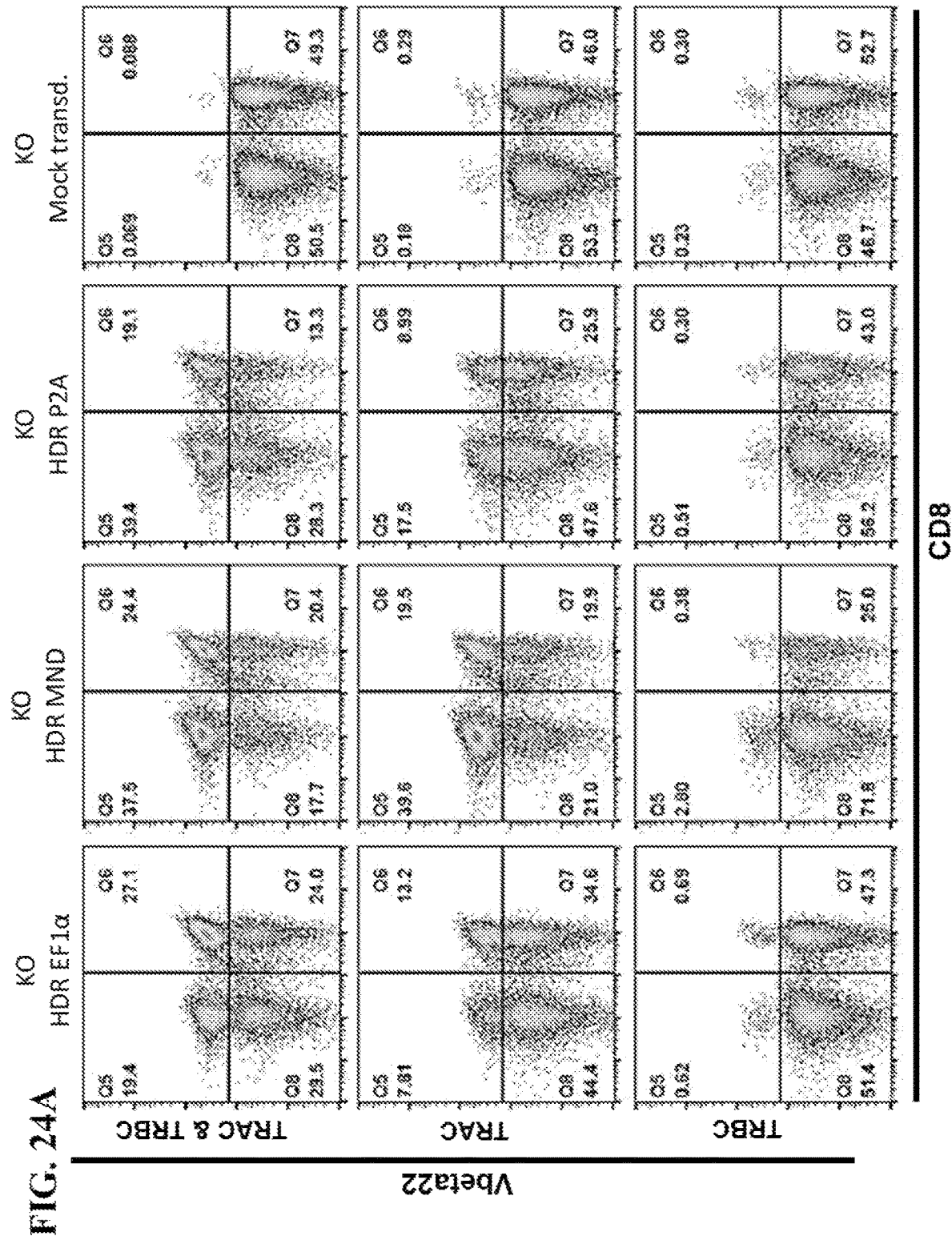
Figure 24B:
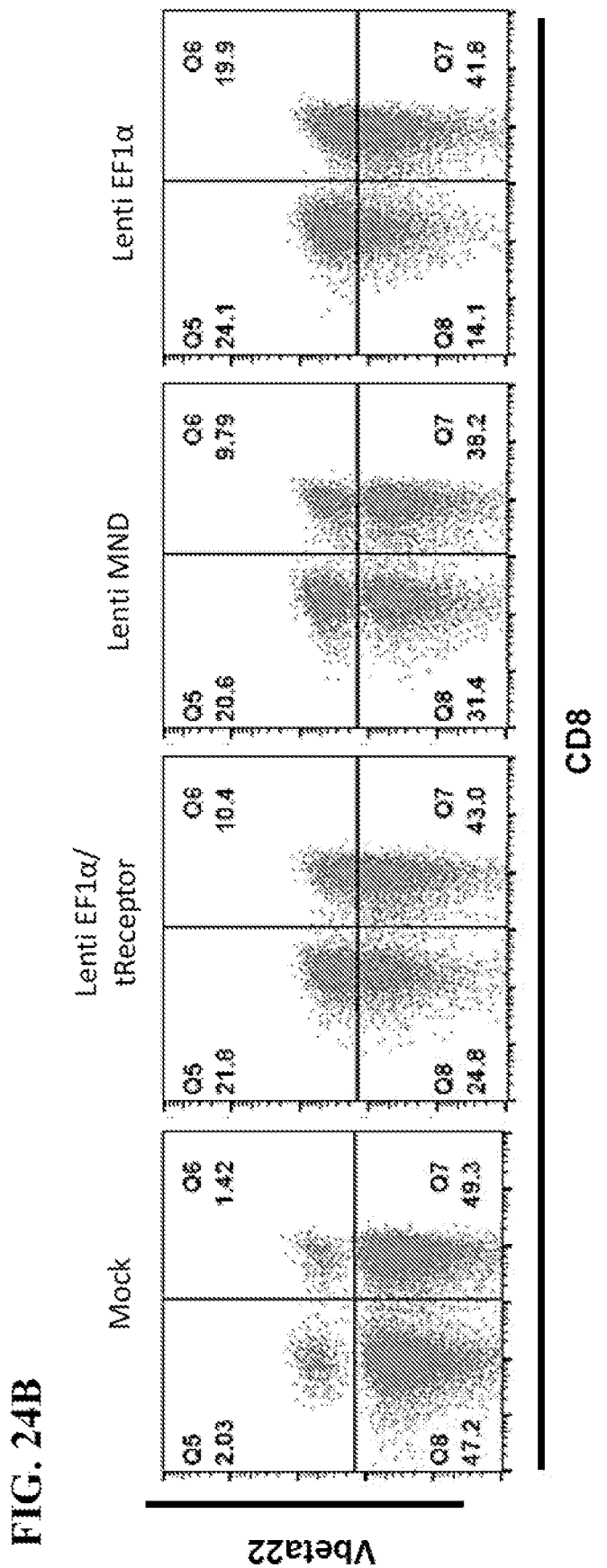
Figure 24C:
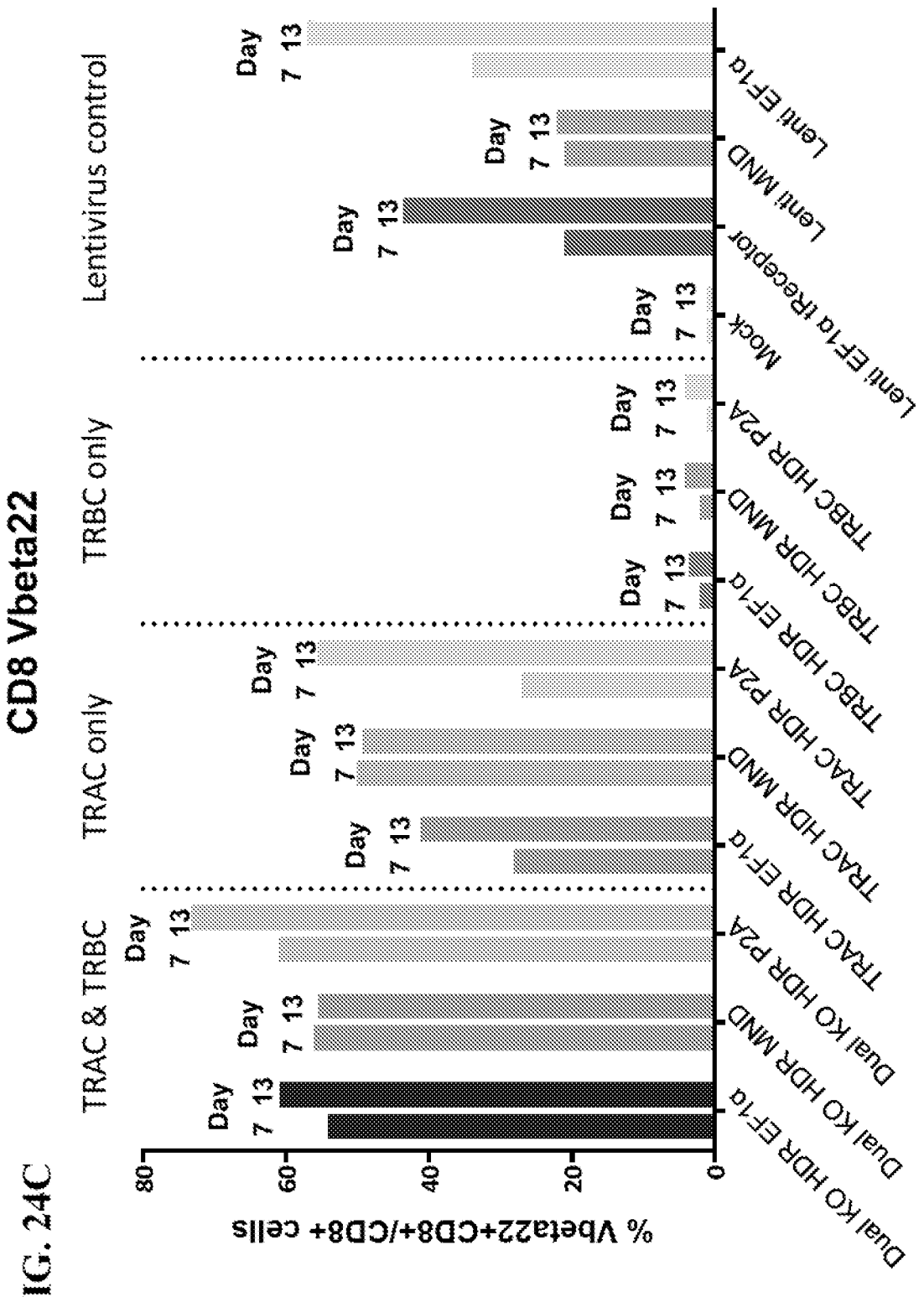
Figure 24D:
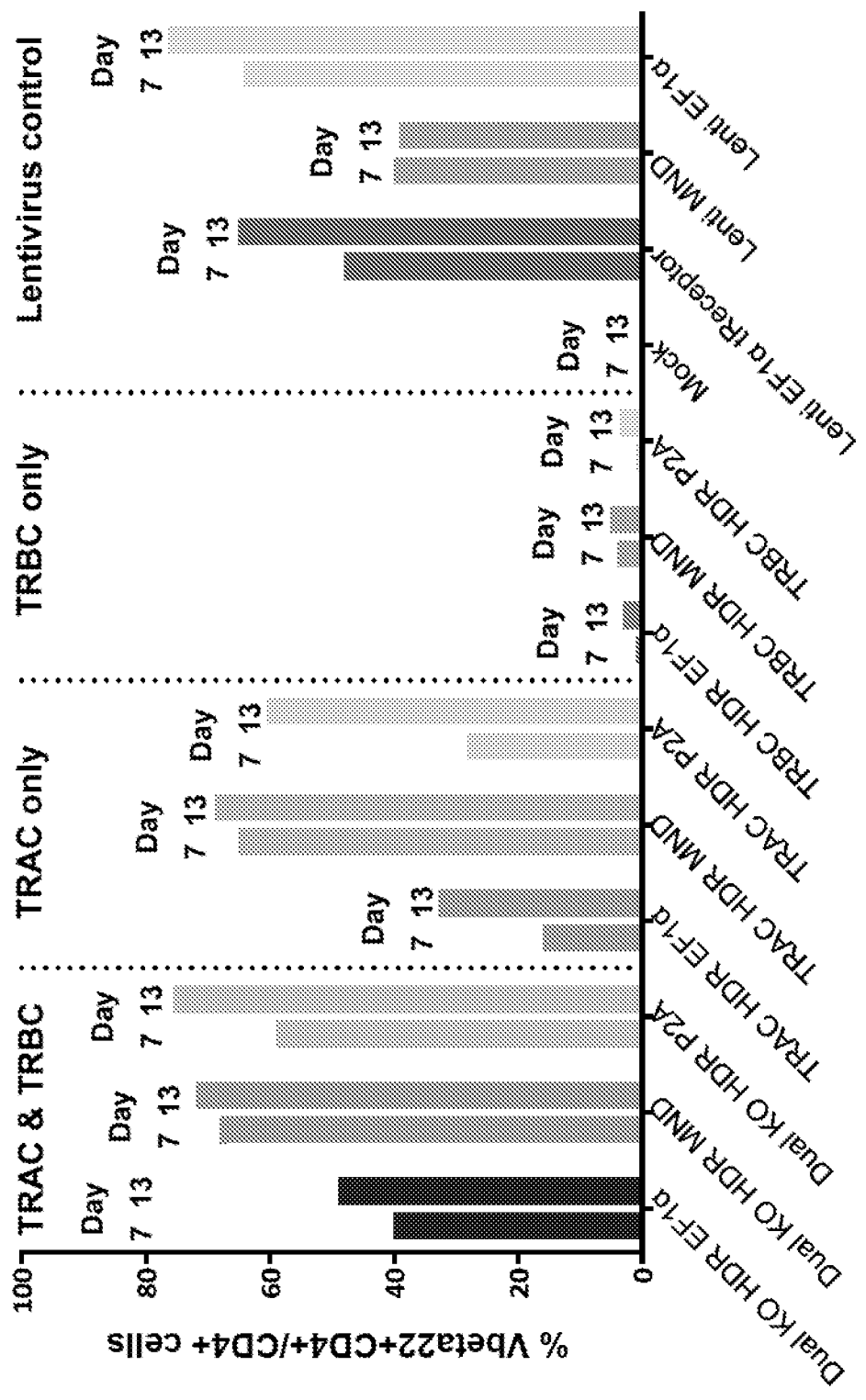

FIGS. 24A-24D depict surface expression of Vbeta22 (recombinant TCR-specific staining) and CD8, as assessed by flow cytometry, for T cells subject to knockout of endogenous TCR encoding genes, engineered to express a recombinant T cell receptor (TCR) using various methods of expression: cells subject to CRISPR/Cas9 mediated knockout (KO) of TRAC, TRBC or both TRAC and TRBC; cells subject to targeted integration by HDR at the TRAC locus of the recombinant TCR-encoding sequences linked to the EF1α promoter, MND promoter or endogenous TCR alpha promoter using a P2A ribosome skip sequence ("HDR EF1α," "HDR MND" or "HDR P2A," respectively) or cells subject to mock transduction as control ("mock transd") (FIG. 24A); cells retaining expression of the endogenous TCR and subject to lentiviral transduction for random integration of the recombinant TCR-encoding sequences linked to the EF1α promoter ("lenti EF1α") or MND promoter ("lenti MND"), or linked to EF1α promoter with sequences encoding a truncated receptor as a surrogate marker ("lenti EF1α/Receptor"), or subject to mock transduction as a control ("mock") (FIG. 24B). FIGS. 24C and 24D depict the percentage of Vbeta22+CD8+ cells among CD8+ cells (FIG. 24C) and the percentage of Vbeta22+CD4+ cells among CD4+ cells (FIG. 24D) in each of the groups described above, on day 7 and day 13.

Figure 25:
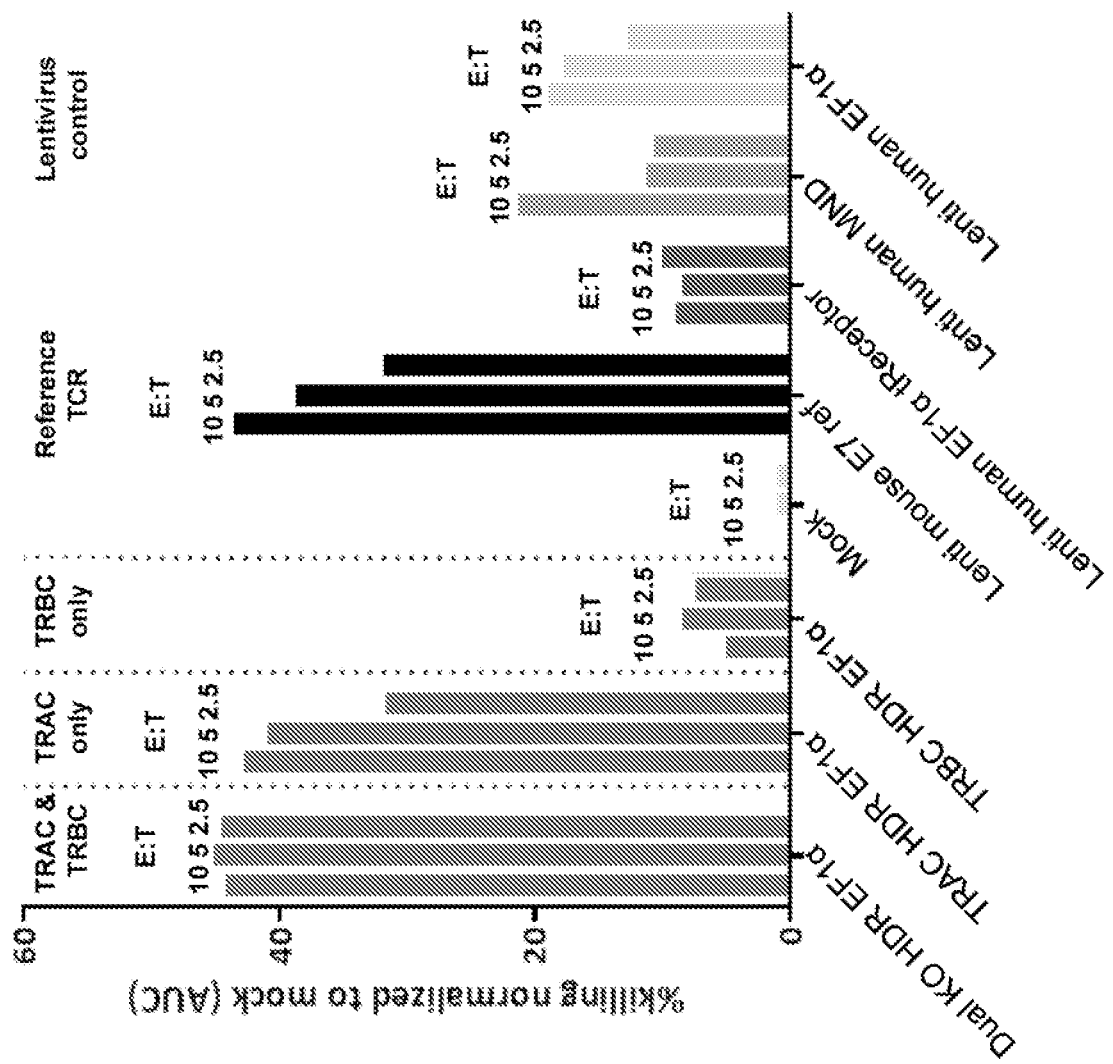

FIG. 25 depict the cytolytic activity of the various recombinant TCR-expressing CD8+ T cells as described above, represented by the area under the curve (AUC) of % killing, compared to mock transduction control and normalized to Vbeta22 expression for each group, from incubation of the effector cells as described above with target cells expressing HPV 16 E7 at an effector to target (E:T) ratio of 10:1, 5:1 and 2.5:1. CD8+ cells transduced with a lentivirus encoding a reference TCR capable of binding to HPV 16 E7 but containing mouse Cα and the Cβ regions was assessed as a control ("lenti mouse E7 ref").

Figure 26:
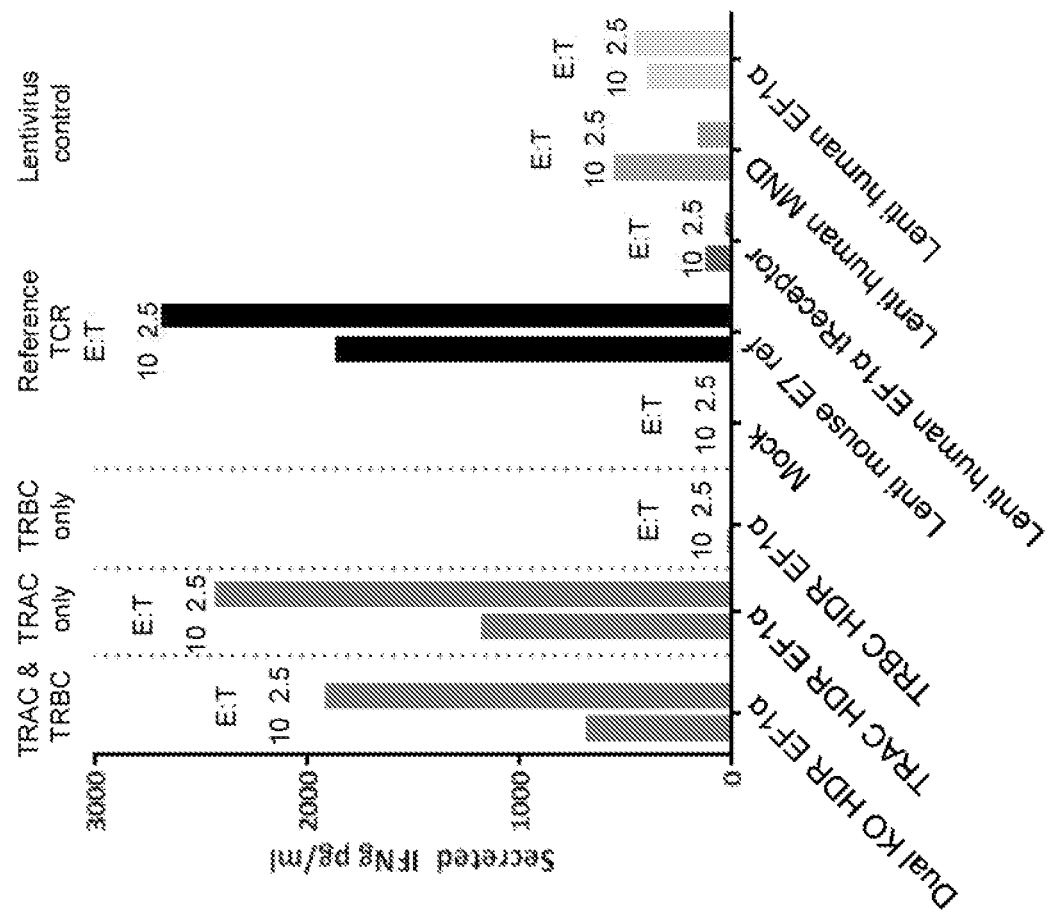

FIG. 26 depict the IFNγ secretion (pg/mL) by the various recombinant TCR-expressing CD8+ T cells as described above, from incubation of the effector cells as described above with target cells expressing HPV 16 E7 at an effector to target (E:T) ratio of 10:1 and 2.5:1. CD8+ cells transduced with a lentivirus encoding a reference TCR capable of binding to HPV 16 E7 but containing mouse Cα and the Cβ regions was assessed as a control ("lenti mouse E7 ref").

Figure 27:
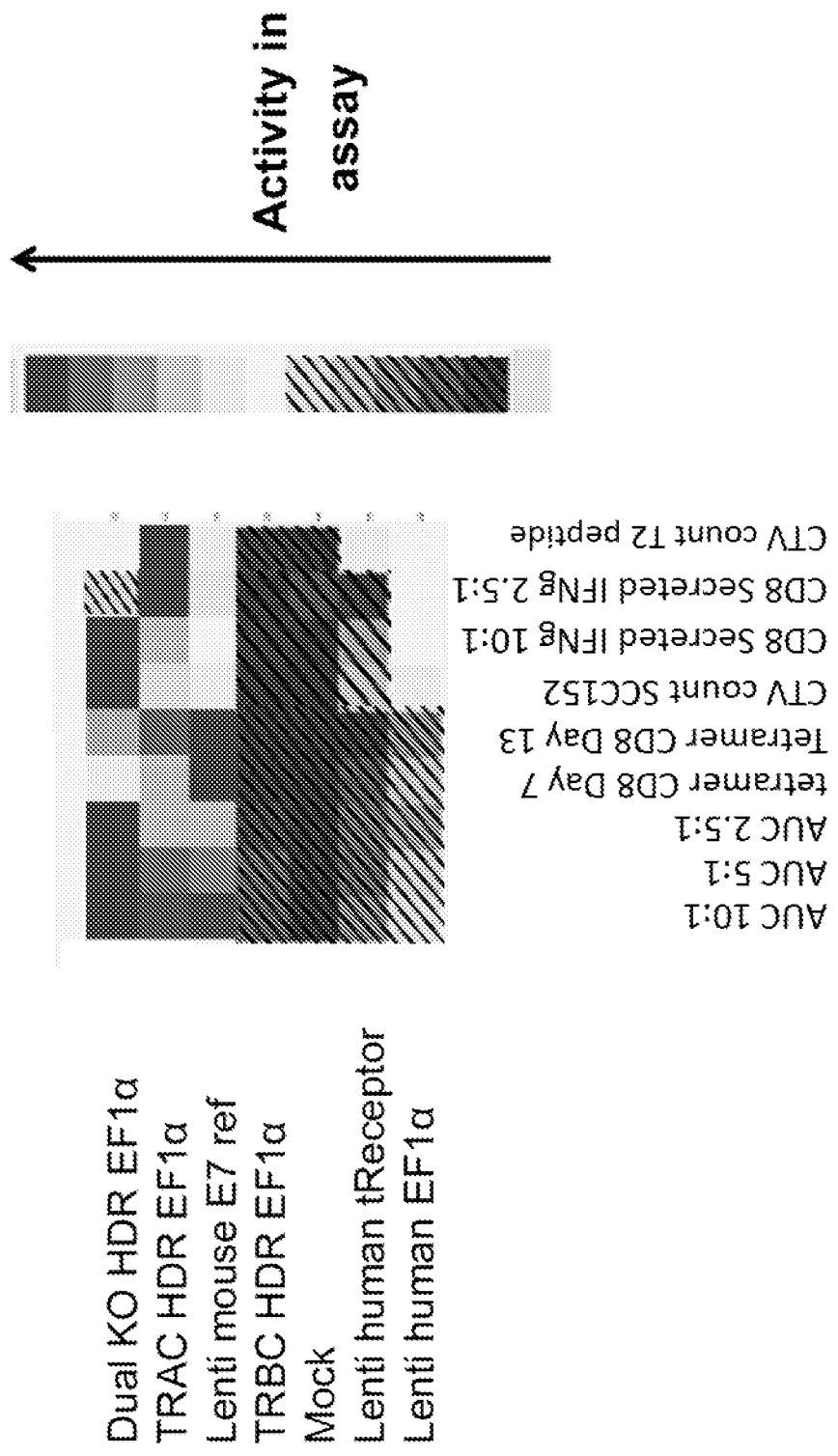

FIG. 27 depicts a heat map showing the relative activity various recombinant TCR-expressing T cells as described above in various functional assays: AUC of % killing at E:T ratios of 10:1, 5:1 and 2.5:1 ("AUC"), tetramer binding in CD8+ cells on days 7 and 13 ("tetramer CD8"), proliferation assay ("CTV count") using SCC152 cells or T2 target cells pulsed with the antigen peptide and secretion of IFNγ from CD8+ cells ("CD8 secreted IFNg").

DETAILED DESCRIPTION

I. T Cell Receptors and Other HPV-Specific Binding Molecules

Provided herein are binding molecules, such as those that bind or recognize a peptide epitope of human papillomavirus (HPV) 16, e.g., a peptide epitope of HPV 16 E6 or E7, in the context of an MHC molecule. Such binding molecules include T cell receptors (TCRs) and antigen-binding fragments thereof and antibodies and antigen binding fragments thereof that exhibit antigenic specificity for binding or recognizing a peptide epitope of HPV 16 E6 or HPV 16 E7. Also provided in some embodiments are nucleic acid molecules encoding the binding molecules, engineered cells containing the binding molecules, compositions and methods of treatment involving administering such binding molecules, engineered cells or compositions.

HPV is a causative organism in most cases of cervical cancer and has been implicated in anal, vaginal, vulvar, penile, and oropharyngeal cancers, and other cancers. Generally, the HPV genome contains an early region containing six open reading frames (E1, E2, E4, E5, E6 and E7), which encode proteins involved in cell transformation and replication, and a late region containing two open reading frames (L1 and L2), which encode proteins of the viral capsid. In general, E6 and E7 are oncogenes that can affect cell cycle regulation and contribute to the formation of cancers. For instance, the E6 gene product can cause p53 degradation and the E7 gene product can cause retinoblastoma (Rb) inactivation.

In some aspects, a provided HPV 16 binding molecule, including a TCR or antigen binding fragment thereof or an anti-HPV 16 antibody, e.g., antibody fragments thereof, and proteins such as chimeric molecules containing one or more of the foregoing, such as the chimeric receptors, e.g., TCR-like CARs, and/or engineered cells expressing the TCRs or CARs, bind to a peptide epitope derived from HPV16 E6 protein. In some aspects, a provided HPV 16 binding molecule, including a TCR or antigen binding fragments thereof or anti-HPV 16 antibody, e.g., antibody fragments and proteins containing the same, such as the chimeric receptors, e.g., TCR-like CARs, and/or engineered cells expressing the TCRs or CARs, binds to a peptide epitope derived from HPV16 E7 protein.

In some aspects, the binding molecule recognizes or binds HPV 16 E6 or E7 epitopes in the context of an MHC molecule, such as an MHC Class I molecule. In some aspects, the MHC Class I molecule is an HLA-A2 molecule, including any one or more subtypes thereof, e.g. HLA-A*0201, *0202, *0203, *0206, or *0207. In some cases, there can be differences in the frequency of subtypes between different populations. For example, in some embodiments, more than 95% of the HLA-A2 positive Caucasian population is HLA-A*0201, whereas in the Chinese population the frequency has been reported to be approximately 23% HLA-A*0201, 45% HLA-A*0207, 8% HLA-A*0206 and 23% HLA-A*0203. In some embodiments, the MHC molecule is HLA-A*0201.

In some embodiments, the TCR or antigen-binding fragment thereof recognizes or binds to an epitope or region of HPV16 E6 or HPV 16 E7, such as a peptide epitope containing an amino acid sequence set forth in any of SEQ ID NOs: 232-239, and as shown below in Table 1.

TABLE 1

| HPV-16 Epitopes | | |
| --- | --- | --- |
| Epitope Description | Epitope Name | SEQ ID NO. |
| KLPQLCTEL | E6(18-26) | 232 |
| TIHDIILECV | E6(29-38) | 233 |
| FAFRDLCIV | E6(52-60) | 234 |
| TLGIVCPI | E7(86-93) | 235 |
| YMLDLQPET | E7(11-19) | 236 |
| GTLGIVCPI | E7(85-93) | 237 |
| LLMGTLGIV | E7(82-90) | 238 |
| TLHEYMLDL | E7(7-15) | 239 |

In some embodiments, the binding molecule, e.g., TCR or antigen-binding fragment thereof or antibody or antigen-binding fragment thereof, is isolated or purified or is recombinant. In some aspects, the binding molecule, e.g., TCR or antigen-binding fragment thereof or antibody or antigen-binding fragment thereof, is human. In some embodiments, the binding molecule is monoclonal. In some aspects, the binding molecule is a single chain. In other embodiments, the binding molecule contains two chains. In some embodiments, the binding molecule, e.g., TCR or antigen-binding fragment thereof or antibody or antigen-binding fragment thereof, is expressed on the surface of a cell.

In some aspects, the provided binding molecules have one or more specified functional features, such as binding properties, including binding to particular epitopes, and/or particular binding affinities as described.

A. T Cell Receptors (TCRs)

In some embodiments, the binding molecule that recognizes or binds an epitope or region of HPV 16 is a T cell receptor (TCR) or an antigen-binding fragment thereof.

In some embodiments, a "T cell receptor" or "TCR" is a molecule that contains a variable α and β chains (also known as TCRα and TCRβ, respectively) or a variable γ and δ chains (also known as TCRγ and TCRδ, respectively), or antigen-binding portions thereof, and which is capable of specifically binding to a peptide bound to an MHC molecule. In some embodiments, the TCR is in the αβ form. Typically, TCRs that exist in αβ and γδ forms are generally structurally similar, but T cells expressing them may have distinct anatomical locations or functions. A TCR can be found on the surface of a cell or in soluble form. Generally, a TCR is found on the surface of T cells (or T lymphocytes) where it is generally responsible for recognizing antigens bound to major histocompatibility complex (MHC) molecules.

Unless otherwise stated, the term "TCR" should be understood to encompass full TCRs as well as antigen-binding portions or antigen-binding fragments thereof. In some embodiments, the TCR is an intact or full-length TCR, such as a TCR containing the α chain and β chain. In some embodiments, the TCR is an antigen-binding portion that is less than a full-length TCR but that binds to a specific peptide bound in an MHC molecule, such as binds to an MHC-peptide complex. In some cases, an antigen-binding portion or fragment of a TCR can contain only a portion of the structural domains of a full-length or intact TCR, but yet is able to bind the peptide epitope, such as MHC-peptide complex, to which the full TCR binds. In some cases, an antigen-binding portion contains the variable domains of a TCR, such as variable α ($V_\alpha$) chain and variable β ($V_\beta$) chain of a TCR, or antigen-binding fragments thereof sufficient to form a binding site for binding to a specific MHC-peptide complex.

In some embodiments, the variable domains of the TCR contain complementarity determining regions (CDRs), which generally are the primary contributors to antigen recognition and binding capabilities and specificity of the peptide, MHC and/or MHC-peptide complex. In some embodiments, a CDR of a TCR or combination thereof forms all or substantially all of the antigen-binding site of a given TCR molecule. The various CDRs within a variable region of a TCR chain generally are separated by framework regions (FRs), which generally display less variability among TCR molecules as compared to the CDRs (see, e.g., Jores et al., Proc. Nat'l Acad. Sci. U.S.A. 87:9138, 1990; Chothia et al., EMBO J. 7:3745, 1988; see also Lefranc et al., Dev. Comp. Immunol. 27:55, 2003). In some embodiments, CDR3 is the main CDR responsible for antigen binding or specificity, or is the most important among the three CDRs on a given TCR variable region for antigen recognition, and/or for interaction with the processed peptide portion of the peptide-MHC complex. In some contexts, the CDR1 of the alpha chain can interact with the N-terminal part of certain antigenic peptides. In some contexts, CDR1 of the beta chain can interact with the C-terminal part of the peptide. In some contexts, CDR2 contributes most strongly to or is the primary CDR responsible for the interaction with or recognition of the MHC portion of the MHC-peptide complex. In some embodiments, the variable region of the β-chain can contain a further hypervariable region (CDR4 or HVR4), which generally is involved in superantigen binding and not antigen recognition (Kotb (1995) Clinical Microbiology Reviews, 8:411-426).

In some embodiments, the α-chain and/or β-chain of a TCR also can contain a constant domain, a transmembrane domain and/or a short cytoplasmic tail (see, e.g., Janeway et al., Immunobiology: The Immune System in Health and Disease, $3^{rd}$ Ed., Current Biology Publications, p. 4:33, 1997). In some aspects, each chain (e.g. alpha or beta) of the TCR can possess one N-terminal immunoglobulin variable domain, one immunoglobulin constant domain, a transmembrane region, and a short cytoplasmic tail at the C-terminal end. In some embodiments, a TCR, for example via the cytoplasmic tail, is associated with invariant proteins of the CD3 complex involved in mediating signal transduction. In some cases, the structure allows the TCR to associate with other molecules like CD3 and subunits thereof. For example, a TCR containing constant domains with a transmembrane region may anchor the protein in the cell membrane and associate with invariant subunits of the CD3 signaling apparatus or complex. The intracellular tails of CD3 signaling subunits (e.g. CD3γ, CD3δ, CD3ε and CD3ζ chains) contain one or more immunoreceptor tyrosine-based activation motif or ITAM and generally are involved in the signaling capacity of the TCR complex.

It is within the level of a skilled artisan to determine or identify the various domains or regions of a TCR. In some cases, the exact locus of a domain or region can vary depending on the particular structural or homology modeling or other features used to describe a particular domain. It is understood that reference to amino acids, including to a specific sequence set forth as a SEQ ID NO used to describe domain organization of a TCR are for illustrative purposes and are not meant to limit the scope of the embodiments provided. In some cases, the specific domain (e g variable or constant) can be several amino acids (such as one, two, three or four) longer or shorter. In some aspects, residues of a TCR are known or can be identified according to the International Immunogenetics Information System (IMGT) numbering system (see e.g. www.imgt.org; see also, Lefranc et al. (2003) Developmental and Comparative Immunology, 2&; 55-77; and The T Cell Factsbook 2nd Edition, Lefranc and LeFranc Academic Press 2001). Using this system, the CDR1 sequences within a TCR Vα chains and/or Vβ chain correspond to the amino acids present between residue numbers 27-38, inclusive, the CDR2 sequences within a TCR Vα chain and/or Vβ chain correspond to the amino acids present between residue numbers 56-65, inclusive, and the CDR3 sequences within a TCR Vα chain and/or Vβ chain correspond to the amino acids present between residue numbers 105-117, inclusive.

In some embodiments, the α chain and β chain of a TCR each further contain a constant domain. In some embodiments, the α chain constant domain (Cα) and β chain constant domain (Cβ) individually are mammalian, such as is a human or murine constant domain. In some embodiments, the constant domain is adjacent to the cell membrane. For example, in some cases, the extracellular portion of the TCR formed by the two chains contains two membrane-proximal constant domains, and two membrane-distal variable domains, which variable domains each contain CDRs.

In some embodiments, each of the Cα and Cβ domains is human. In some embodiments, the Cα is encoded by the TRAC gene (IMGT nomenclature) or is a variant thereof. In some embodiments, the Cα has or comprises the sequence of amino acids set forth in SEQ ID NO: 213 or 220 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 213 or 220. In some embodiments, the Cα has or comprises the sequence of amino acids set forth in SEQ ID NO: 212, 215 or 217 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 212, 215 or 217. In some embodiments, the Cα has or comprises the sequence of amino acids set forth in any of SEQ ID NOS: 212, 213, 215, 217, 220, or 524. In some embodiments, the Cβ is encoded by TRBC1 or TRBC2 genes (IMGT nomenclature) or is a variant thereof. In some embodiments, the Cβ has or comprises the sequence of amino acids set forth in SEQ ID NO:214, 216, 631, or 889 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 214, 216, 631, or 889. In some embodiments, the Cβ has or comprises the sequence of amino acids set forth in SEQ ID NO: 214, 216, 631, or 889.

In some embodiments, any of the provided TCRs or antigen-binding fragments thereof can be a human/mouse chimeric TCR. In some cases, the TCR or antigen-binding fragment thereof comprises an alpha chain and/or a beta chain comprising a mouse constant region. In some embodiments, the Cα is a mouse constant region that is or comprises the sequence of amino acids set forth in SEQ ID NO: 262, 317, 833, 1012, 1014, 1015, 1017 or 1018 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 262, 317, 833, 1012, 1014, 1015, 1017 or 1018. In some embodiments, the Cα is or comprises the sequence of amino acids set forth in SEQ ID NO: 262, 317, 833, 1012, 1014, 1015, 1017 or 1018. In some embodiments, the Cβ is a mouse constant region that is or comprises the sequence of amino acids set forth in SEQ ID NO: 263, 109, 1013 or 1016 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 263, 109, 1013 or 1016. In some embodiments, the Cβ is or comprises the sequence of amino acids set forth in SEQ ID NO: 263, 109, 1013 or 1016. In some embodiments, the Cα is or comprises the sequence of amino acids set forth in SEQ ID NO: 262 or 1014 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 262 or 1014 and/or the Cβ is or comprises the sequence of amino acids set forth in SEQ ID NO: 263 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 263. In some embodiments, the Cα and/or Cβ is or comprises any Cα and/or Cβ described in WO 2015/184228, WO 2015/009604 and WO 2015/009606.

In some embodiments, the TCR or antigen-binding fragment thereof herein comprises a variant of an alpha chain and/or a beta chain, e.g., an alpha and/or beta chain that comprises a mouse constant region. In some embodiments, the variant comprises the amino acid sequence of any of the TCRs described herein with one, two, three, or four or more amino acid substitution(s) in the constant region of the alpha or beta chain. In some embodiments, the variant comprises the amino acid sequence of any of the constant regions described herein with one, two, three, or four or more amino acid substitution(s) in the constant region. In some embodiments, the TCRs (or functional portions thereof) comprising the substituted amino acid sequence(s) advantageously provide one or more of increased recognition of HPV 16 targets, increased expression by a host cell, and increased anti-tumor activity as compared to the parent TCR comprising an unsubstituted amino acid sequence.

In some embodiments, the substituted amino acid sequences of the mouse constant regions of the TCR α and β chains, SEQ ID NOs: 1015 and 1016, respectively, correspond with all or portions of the unsubstituted mouse constant region amino acid sequences SEQ ID NOs: 1014 and 263, respectively, with SEQ ID NO: 1015 having one, two, three, or four amino acid substitution(s) when compared to SEQ ID NO: 1014 and SEQ ID NO: 1016 having one amino acid substitution when compared to SEQ ID NO: 263. In some embodiments, a variant of a TCR comprises the amino acid sequences of (a) SEQ ID NO: 1015 (constant region of alpha chain), wherein (i) X at position 48 is Thr or Cys; (ii) X at position 112 is Ser, Gly, Ala, Val, Leu, Ile, Pro, Phe, Met, or Trp; (iii) X at position 114 is Met, Gly, Ala, Val, Leu, Ile, Pro, Phe, Met, or Trp; and (iv) X at position 115 is Gly, Ala, Val, Leu, Ile, Pro, Phe, Met, or Trp; and (b) SEQ ID NO: 1016 (constant region of beta chain), wherein X at position 56 is Ser or Cys. In some embodiments, the Cα is or comprises the sequence of amino acids set forth in SEQ ID NO: 1015 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1015 and/or the Cβ is or comprises the sequence of amino acids set forth in SEQ ID NO: 1016 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1016.

In some embodiments, the TCR may be a heterodimer of two chains α and β that are linked, such as by a disulfide bond or disulfide bonds. In some embodiments, the constant domain of the TCR may contain short connecting sequences in which a cysteine residue forms a disulfide bond, thereby linking the two chains of the TCR. In some embodiments, a TCR may have an additional cysteine residue in each of the α and β chains, such that the TCR contains two disulfide bonds in the constant domains. In some embodiments, each of the constant and variable domains contains disulfide bonds formed by cysteine residues.

In some embodiments, the TCR can contain an introduced disulfide bond or bonds. In some embodiments, the native disulfide bonds are not present. In some embodiments, the one or more of the native cysteines (e.g. in the constant domain of the α chain and β chain) that form a native interchain disulfide bond are substituted to another residue, such as to a serine or alanine. In some embodiments, an introduced disulfide bond can be formed by mutating non-cysteine residues on the alpha and beta chains, such as in the constant domain of the α chain and β chain, to cysteine. Opposing cysteines in the TCR α and β chains in provide a disulfide bond that links the constant regions of TCR α and β chains of the substituted TCR to one another and which is not present in a TCR comprising the unsubstituted human constant region or the unsubstituted mouse constant region. In some embodiments, the presence of non-native cysteine residues (e.g. resulting in one or more non-native disulfide bonds) in a recombinant TCR can favor production of the desired recombinant TCR in a cell in which it is introduced over expression of a mismatched TCR pair containing a native TCR chain.

Exemplary non-native disulfide bonds of a TCR are described in published International PCT No. WO2006/000830 and WO2006/037960. In some embodiments, cysteines can be introduced or substituted at residue Thr48 of the Cα chain and Ser57 of the Cβ chain, at residue Thr45 of the Cα chain and Ser77 of the Cβ chain, at residue Tyr10 of the Cα chain and Ser17 of the Cβ chain, at residue Thr45 of the Cα chain and Asp59 of the Cβ chain and/or at residue Ser15 of the Cα chain and Glu15 of the Cβ chain with reference to numbering of a Cα set forth in any of SEQ ID NOS: 212, 213, 217, or 524, or Cβ set forth in SEQ ID NO: 214 or 216. In some embodiments, the variant of the TCR is a cysteine-substituted, chimeric TCR in which one or both of the native Thr48 of SEQ ID NO: 1014 and the native Ser57 of SEQ ID NO: 263 is substituted with Cys. In some embodiments, the Cα is or comprises the sequence of amino acids set forth in SEQ ID NO: 1017 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1017 and/or the Cβ is or comprises the sequence of amino acids set forth in SEQ ID NO: 1016 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1013.

In some embodiments, any of the provided cysteine mutations can be made at a corresponding position in another sequence, for example, in the mouse Cα and Cβ sequences described above. The term "corresponding" with reference to positions of a protein, such as recitation that amino acid positions "correspond to" amino acid positions in a disclosed sequence, such as set forth in the Sequence listing, refers to amino acid positions identified upon alignment with the disclosed sequence based on structural sequence alignment or using a standard alignment algorithm, such as the GAP algorithm. For example, corresponding residues can be determined by alignment of a reference sequence with the Cα sequence set forth in any of SEQ ID NOS: 212, 213, 215, 217, 220, or 524, or the Cβ sequence set forth in SEQ ID NO: 214, 216, 631, or 889, by structural alignment methods as described herein. By aligning the sequences, one skilled in the art can identify corresponding residues, for example, using conserved and identical amino acid residues as guides.

In some embodiments, the variant includes substitutions of one, two, or three amino acids in the transmembrane (TM) domain of the constant region of one or both of the α and β chains with a hydrophobic amino acid to provide a hydrophobic amino acid-substituted TCR. The hydrophobic amino acid substitution(s) in the TM domain of the TCR may increase the hydrophobicity of the TM domain of the TCR as compared to a TCR that lacks the hydrophobic amino acid substitution(s) in the TM domain. In some embodiments, the variant of the TCR comprises one, two, or three of the native Ser 112, Met 114, and Gly 115 of SEQ ID NO: 1014 may, independently, be substituted with Gly, Ala, Val, Leu, Ile, Pro, Phe, Met, or Trp; for example with Leu, Ile, or Val. In some embodiments, the Cα is or comprises the sequence of amino acids set forth in SEQ ID NO: 1018 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1018 and/or the Cβ is or comprises the sequence of amino acids set forth in SEQ ID NO: 263 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 263.

In some embodiments, the variant includes cysteine substitutions in the constant region of one or both of the α and β chains in combination with the substitution(s) of one, two, or three amino acids in the transmembrane (TM) domain of the constant region of one or both of the α and β chains with a hydrophobic amino acid. In some embodiments, the variant has the native Thr48 of SEQ ID NO: 1014 substituted with Cys; one, two, or three of the native Ser 112, Met 114, and Gly 115 of SEQ ID NO: 1014, independently, substituted with Gly, Ala, Val, Leu, Ile, Pro, Phe, Met, or Trp; for example with Leu, Ile, or Val; and the native Ser56 of SEQ ID NO: 19 substituted with Cys. In some embodiments, the Cα is or comprises the sequence of amino acids set forth in SEQ ID NO: 833 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 833 and/or the Cβ is or comprises the sequence of amino acids set forth in SEQ ID NO: 1013 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1013.

Exemplary sequences (e.g. CDRs, $V_\alpha$ and/or $V_\beta$ and constant region sequences) of provided TCRs are described below.

In some embodiments, the TCR is a full-length TCR. In some embodiments, the TCR is an antigen-binding portion. In some embodiments, the TCR is a dimeric TCR (dTCR). In some embodiments, the TCR is a single-chain TCR (sc-TCR). A TCR may be cell-bound or in soluble form. In some embodiments, the TCR is in cell-bound form expressed on the surface of a cell.

In some embodiments a dTCR contains a first polypeptide wherein a sequence corresponding to a provided TCR α chain variable region sequence is fused to the N terminus of a sequence corresponding to a TCR α chain constant region extracellular sequence, and a second polypeptide wherein a sequence corresponding to a provided TCR β chain variable region sequence is fused to the N terminus a sequence corresponding to a TCR β chain constant region extracellular sequence, the first and second polypeptides being linked by a disulfide bond. In some embodiments, the bond can correspond to the native interchain disulfide bond present in native dimeric αβ TCRs. In some embodiments, the interchain disulfide bonds are not present in a native TCR. For example, in some embodiments, one or more cysteines can be incorporated into the constant region extracellular sequences of dTCR polypeptide pair. In some cases, both a native and a non-native disulfide bond may be desirable. In some embodiments, the TCR contains a transmembrane sequence to anchor to the membrane.

In some embodiments, a dTCR contains a provided TCR α chain containing a variable α domain, a constant α domain and a first dimerization motif attached to the C-terminus of the constant α domain, and a provided TCR β chain comprising a variable β domain, a constant β domain and a first dimerization motif attached to the C-terminus of the constant β domain, wherein the first and second dimerization motifs easily interact to form a covalent bond between an amino acid in the first dimerization motif and an amino acid in the second dimerization motif linking the TCR α chain and TCR β chain together.

In some embodiments, the TCR is a scTCR, which is a single amino acid strand containing an α chain and a β chain that is able to bind to MHC-peptide complexes. Typically, a scTCR can be generated using methods known to those of skill in the art, See e.g., International published PCT Nos.

WO 96/13593, WO 96/18105, WO99/18129, WO 04/033685, WO2006/037960, WO2011/044186; U.S. Pat. No. 7,569,664; and Schlueter, C. J. et al. J. Mol. Biol. 256, 859 (1996).

In some embodiments, a scTCR contains a first segment constituted by an amino acid sequence corresponding to a sequence of a provided TCR α chain variable region, a second segment constituted by an amino acid sequence corresponding to a provided TCR β chain variable region sequence fused to the N terminus of an amino acid sequence corresponding to a TCR β chain constant domain extracellular sequence, and a linker sequence linking the C terminus of the first segment to the N terminus of the second segment.

In some embodiments, a scTCR contains a first segment constituted by an amino acid sequence corresponding to a provided TCR β chain variable region, a second segment constituted by an amino acid sequence corresponding to a provided TCR α chain variable region sequence fused to the N terminus of an amino acid sequence corresponding to a TCR α chain constant domain extracellular sequence, and a linker sequence linking the C terminus of the first segment to the N terminus of the second segment.

In some embodiments, a scTCR contains a first segment constituted by a provided α chain variable region sequence fused to the N terminus of an α chain extracellular constant domain sequence, and a second segment constituted by a provided β chain variable region sequence fused to the N terminus of a sequence β chain extracellular constant and transmembrane sequence, and, optionally, a linker sequence linking the C terminus of the first segment to the N terminus of the second segment.

In some embodiments, a scTCR contains a first segment constituted by a provided TCR β chain variable region sequence fused to the N terminus of a β chain extracellular constant domain sequence, and a second segment constituted by a provided α chain variable region sequence fused to the N terminus of a sequence α chain extracellular constant and transmembrane sequence, and, optionally, a linker sequence linking the C terminus of the first segment to the N terminus of the second segment.

In some embodiments, for the scTCR to bind an MHC-peptide complex, the α and β chains must be paired so that the variable region sequences thereof are orientated for such binding. Various methods of promoting pairing of an α and β in a scTCR are well known in the art. In some embodiments, a linker sequence is included that links the α and β chains to form the single polypeptide strand. In some embodiments, the linker should have sufficient length to span the distance between the C terminus of the α chain and the N terminus of the β chain, or vice versa, while also ensuring that the linker length is not so long so that it blocks or reduces bonding of the scTCR to the target peptide-MHC complex.

In some embodiments, the linker of a scTCRs that links the first and second TCR segments can be any linker capable of forming a single polypeptide strand, while retaining TCR binding specificity. In some embodiments, the linker sequence may, for example, have the formula -P-AA-P-, wherein P is proline and AA represents an amino acid sequence wherein the amino acids are glycine and serine. In some embodiments, the first and second segments are paired so that the variable region sequences thereof are orientated for such binding. Hence, in some cases, the linker has a sufficient length to span the distance between the C terminus of the first segment and the N terminus of the second segment, or vice versa, but is not too long to block or reduces bonding of the scTCR to the target ligand. In some embodiments, the linker can contain from or from about 10 to 45 amino acids, such as 10 to 30 amino acids or 26 to 41 amino acids residues, for example 29, 30, 31 or 32 amino acids. In some embodiments, the linker has the formula -PGGG-(SGGGG)$_n$-P-, wherein n is 5 or 6 and P is proline, G is glycine and S is serine (SEQ ID NO: 266). In some embodiments, the linker has the sequence GSADDAKK-DAAKKDGKS (SEQ ID NO: 267).

In some embodiments, a scTCR contains a disulfide bond between residues of the single amino acid strand, which, in some cases, can promote stability of the pairing between the α and β regions of the single chain molecule (see e.g. U.S. Pat. No. 7,569,664). In some embodiments, the scTCR contains a covalent disulfide bond linking a residue of the immunoglobulin region of the constant domain of the α chain to a residue of the immunoglobulin region of the constant domain of the β chain of the single chain molecule. In some embodiments, the disulfide bond corresponds to the native disulfide bond present in a native dTCR. In some embodiments, the disulfide bond in a native TCR is not present. In some embodiments, the disulfide bond is an introduced non-native disulfide bond, for example, by incorporating one or more cysteines into the constant region extracellular sequences of the first and second chain regions of the scTCR polypeptide. Exemplary cysteine mutations include any as described above. In some cases, both a native and a non-native disulfide bond may be present.

In some embodiments, a scTCR is a non-disulfide linked truncated TCR in which heterologous leucine zippers fused to the C-termini thereof facilitate chain association (see e.g. International published PCT No. WO99/60120). In some embodiments, a scTCR contain a TCRα variable domain covalently linked to a TCRβ variable domain via a peptide linker (see e.g., International published PCT No. WO99/18129).

In some embodiments, any of the provided TCRs, including a dTCR or scTCR, can be linked to signaling domains that yield an active TCR on the surface of a T cell. In some embodiments, the TCR is expressed on the surface of cells. In some embodiments, the TCR does contain a sequence corresponding to a transmembrane sequence. In some embodiments, the transmembrane domain is positively charged. In some embodiments, the transmembrane domain can be a Cα or Cβ transmembrane domain. In some embodiments, the transmembrane domain can be from a non-TCR origin, for example, a transmembrane region from CD3z, CD28 or B7.1. In some embodiments, the TCR does contain a sequence corresponding to cytoplasmic sequences. In some embodiments, the TCR contains a CD3z signaling domain. In some embodiments, the TCR is capable of forming a TCR complex with CD3.

In some embodiments, the TCR is a soluble TCR. In some embodiments, the soluble TCR has a structure as described in WO99/60120 or WO 03/020763. In some embodiments, the TCR does not contain a sequence corresponding to the transmembrane sequence, for example, to permit membrane anchoring into the cell in which it is expressed. In some embodiments, the TCR does not contain a sequence corresponding to cytoplasmic sequences.

1. Exemplary TCRs

In some embodiments, among the provided -TCRs or antigen-binding fragments thereof that bind or recognize a peptide epitope of HPV 16 in the context of an MHC (e.g. a peptide epitope of HPV 16 E6 or a peptide epitope of HPV 16 E7) are TCRs or antigen-binding fragments thereof that contain any of the alpha and/or beta chain variable (V$_α$ or V$_β$) region sequences as described, individually, or a sufficient antigen-binding portion of such chain(s). In some embodiments, the provided anti-HPV 16 TCR or antigen-binding fragment thereof (e.g. anti-HPV 16 E6 or anti-HPV 16 E7 TCRs) contains a $V_\alpha$ region sequence or sufficient antigen-binding portion thereof that contains a CDR-1, CDR-2 and/or CDR-3 as described. In some embodiments, the provided anti-HPV 16 TCR or antigen-binding fragment thereof (e.g., anti-HPV 16 E6 or anti-HPV 16 E7 TCRs) contains a $V_\beta$ region sequence or sufficient antigen-binding portion that contains a CDR-1, CDR-2 and/or CDR-3 as described. In some embodiments, the anti-HPV 16 TCR or antigen-binding fragment thereof (e.g. anti-HPV 16 E6 or anti-HPV 16 E7 TCRs) contains a $V_\alpha$ region sequence that contains a CDR-1, CDR-2 and/or CDR-3 as described and contains a $V_\beta$ region sequence that contains a CDR-1, CDR-2 and/or CDR-3 as described. Also among the provided TCRs are those having sequences at least at or about 90, 91, 92, 93, 94, 95, 96, 97, 98, or 99% identical to such a sequence.

In some embodiments, the TCR contains a $V_\alpha$ region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO:1365), where $X_1$ is A, I, or V; $X_2$ is M, L, V, E or A; $X_3$ is R, L, N, or S; $X_4$ is E, V, P, T, F, I, R or A; $X_5$ is G, I, L, A, P, R, D, or H; $X_6$ is R, T, G, S, N or H; $X_7$ is G, R, A, N, or null; $X_8$ is T, G, or null; $X_9$ is null, A or G; $X_{11}$) is null or G; $X_{11}$ is null or G; $X_{12}$ is null or T; $X_{13}$ is F, Y, A, S or null; $X_{14}$ is G, Y, or N; $X_{15}$ is F, G, T, N, Q, or Y; $X_{16}$ is K, P, V, N or A; $X_{17}$ is T, L, or F; and $X_{18}$ is I, V, T, H, or N.

In some embodiments, the TCR contains a $V_\alpha$ region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO: 251), where $X_1$ is A, I, or V; $X_2$ is M, L, V, E or S; $X_3$ is R, L, N, Q, P or S; $X_4$ is E, V, P, T, F, I, R, G, S or A; $X_5$ is G, I, L, A, P, R, D, null or H; $X_6$ is R, T, G, S, N, null or A; $X_7$ is G, R, N, or null; $X_8$ is T, G, or null; $X_9$ is null, or A; $X_{10}$ is null or G; $X_{11}$ is null or G; $X_{12}$ is null or T; $X_{13}$ is F, Y, S or null; $X_{14}$ is G, Y, null or N; $X_{15}$ is F, G, T, N, Q, or Y; $X_{16}$ is K, P, V, N or A; $X_1$ is T, L, or F; and $X_{18}$ is I, V, T, H, F or N.

In some embodiments, the TCR or antigen-binding fragment thereof contains a $V_\alpha$ region containing a complementarity determining region 3 (CDR-3) comprising an amino acid sequence set forth in any of SEQ ID NOs: 138, 144, 147, 153, 159, 163, 167, 173, 175, 301, 304, 308, 478, 493, 505, 511, 523, 539, 555, 572, 588, 600, 612, 624, 638, 650, 662, 679, 694, 712, 729, 744, 762, 776, 788, 802, 818, 832, 846, 858, 870, 882, 896, 911, 926, 940, 952, 964, 976, 988, or 1002, or a sequence having at least at or about 90, 91, 92, 93, 94, 95, 96, 97, 98, or 99% identity with such a sequence. In some aspects, the TCR or antigen-binding fragment thereof contains a $V_\alpha$ region containing a CDR3 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999, or a sequence at least at or about 90, 91, 92, 93, 94, 95, 96, 97, 98, or 99% identical with such a sequence.

In some embodiments, the TCR contains a $V_\beta$ region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}$ (SEQ ID NO: 1366), where $X_1$ is A or S; $X_2$ is S, I, or V; $X_3$ is S, T, or V; $X_4$ is H, P, L, Y, T, D, or Q; $X_5$ is L, G, W, F, S, or R; $X_6$ is A, G, L, S, or T; $X_7$ is G, E, A, T, R, or null; $X_8$ is null or G; $X_9$ is null or G; $X_{10}$ is null, F, G, T, S, or A; $X_{11}$ is T, N, H, A, S, or F; $X_{12}$ is G, T, Q, D, Y, or L; $X_{13}$ is E, P, T, G or W; $X_{14}$ is L, A, Q, Y, or K; and $X_{15}$ is F, H, Y, or T.

In some embodiments, the TCR contains a $V_\beta$ region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}$ (SEQ ID NO: 261), where $X_1$ is A or S; $X_2$ is 5, I, or V; $X_3$ is 5, T, or V; $X_4$ is H, P, L, Y, T, D, or F; $X_5$ is L, G, W, F, 5, T or R; $X_6$ is A, G, L, 5, or T; $X_7$ is G, E, A, T, R, Q or null; $X_8$ is null or G; $X_9$ is null or G; $X_{10}$ is null, F, G, T, S, or R; $X_{11}$ is T, N, H, A, S, R or E; $X_{12}$ is G, T, Q, D, Y, or R; $X_{13}$ is E, P, T, or G; $X_{14}$ is L, A, Q, or Y; and $X_{15}$ is F, H, Y, or T.

In some instances, the TCR contains a $V_\beta$ region containing a complementarity determining region 3 (CDR-3) comprising an amino acid sequence set forth in any of SEQ ID NOs: 141, 146, 150, 156, 160, 164, 170, 174, 178, 305, 309, 486, 499, 517, 531, 548, 563, 581, 594, 606, 618, 630, 644, 656, 670, 686, 703, 721, 736, 753, 769, 782, 794, 809, 825, 840, 852, 864, 876, 888, 902, 919, 932, 946, 958, 970, 982, 994, 1010, or 1381, or a sequence having at least at or about 90, 91, 92, 93, 94, 95, 96, 97, 98, or 99% identity with such a sequence. In some embodiments, the TCR contains a $V_\beta$ region containing a CDR3 contained within the amino acid sequence set forth in any of SEQ ID NOs: 112, 114, 116, 118, 120, 122, 124, 126, 128, 296, 298, 300, 483, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, 1008, or 1380, or a sequence at least at or about 90, 91, 92, 93, 94, 95, 96, 97, 98, or 99% identical with such a sequence.

In some aspects, the $V_\alpha$ region further contains a complementarity determining region 1 (CDR-1) comprising the amino acid sequence $X_1X_2X_3X_4X_5X_6X_7$ (SEQ ID NO: 1367), where $X_1$ is T, D, N, or V; $X_2$ is I or S; $X_3$ is S, D, A, P, or M; $X_4$ is G, Q, P, or null; $X_5$ is T, S, I, or F; $X_6$ is D, Y, Q, T, or S; and $X_7$ is Y, G, N, or Q. In some embodiments, the $V_\alpha$ region further contains a complementarity determining region 2 (CDR-2) comprising the amino acid sequence $X_1X_2X_3X_4X_5X_6X_7X_8$ (SEQ ID NO: 247), where $X_1$ is G, Q, I, V, or M; $X_2$ is L, S, Q, Y, F, T, or G; $X_3$ is T, G, S, or F; $X_4$ is Y, S, N, I, or null; $X_5$ is null or D; $X_6$ is null, E, Q, S, M, or K; $X_7$ is S, Q, R, G, D, or N; and $X_8$ is N, E, M, T, or K.

In some aspects, the $V_\alpha$ region further contains a complementarity determining region 1 (CDR-1) comprising the amino acid sequence $X_1X_2X_3X_4X_5X_6X_7$ (SEQ ID NO: 243), where $X_1$ is T, D, N, S or V; $X_2$ is I or S; $X_3$ is S, D, A, P, N or Y; $X_4$ is G, Q, P, or null; $X_5$ is T, S, I, or F; $X_6$ is D, Y, Q, T, P or 5; and $X_7$ is Y, G, N, A, S or Q.

In some embodiments, the $V_\alpha$ region contains a complementarity determining region 1 (CDR-1) comprising an amino acid sequence set forth in any of SEQ ID NOs: 136, 142, 151, 157, 161, 165, 171, 302, 306, 537, 570, 677, 692, 710, 727, 742, 760, 800, 816, 909, 938, or 1000, or a sequence having at least at or about 90, 91, 92, 93, 94, 95, 96, 97, 98, or 99% identity with such a sequence. In some aspects, the $V_\alpha$ region contains a CDR-1 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999, or a sequence having at least at or about 90, 91, 92, 93, 94, 95, 96, 97, 98, or 99% identity with such a sequence. In some embodiments, the $V_\alpha$ region contains a complementarity determining region 2 (CDR-2) comprising an amino acid sequence set forth in any of SEQ ID NOs: 137, 143, 152, 158, 162, 166, 172, 303, 307, 538, 571, 678, 693, 711, 728, 743, 761, 801, 817, 831, 910, 939, or 1001, or a sequence having at least at or about 90, 91, 92, 93, 94, 95, 96, 97, 98, or 99% identity with such a sequence. In some embodiments, the $V_\alpha$ region contains a CDR-2 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999, or a sequence having at least at or about 90, 91, 92, 93, 94, 95, 96, 97, 98, or 99% identity with such a sequence.

In some aspects, the Vβ region further contains a complementarity determining region 1 (CDR-1) comprising the amino acid sequence $X_1X_2X_3X_4X_5$ (SEQ ID NO: 1369), where $X_1$ is S, M, or L; $X_2$ is G, E, D, N, or Q; $X_3$ is H or V; $X_4$ is V, N, E, L, or T; and $X_5$ is S, R, N, Y, A, or M. In some embodiments, the Vβ region further contains a complementarity determining region 2 (CDR-2) comprising the amino acid sequence $X_1X_2X_3X_4X_5X_6X_7$ (SEQ ID NO: 1368), where $X_1$ is F, Y, S, or A; $X_2$ is Q, Y, V, or N; $X_3$ is N, D, G, F, or Q; $X_4$ is null or G; $X_5$ is E, V, N, K, or S; $X_6$ is A, K, G, or E; and $X_7$ is Q, M, T, I, or A.

In some aspects, the Vβ region further contains a complementarity determining region 1 (CDR-1) comprising the amino acid sequence $X_1X_2X_3X_4X_5$ (SEQ ID NO: 254), where $X_1$ is S, or M; $X_2$ is G, E, D, N, or Q; $X_3$ is H or V; $X_4$ is V, N, E, L, or T; and $X_5$ is S, R, N, Y, or M. In some embodiments, the Vβ region further contains a complementarity determining region 2 (CDR-2) comprising the amino acid sequence $X_1X_2X_3X_5X_6X_7$ (SEQ ID NO: 257), where $X_1$ is F, S, or A; $X_2$ is Q, Y, V, or N; $X_3$ is N, D, G, or Q; $X_5$ is E, V, N, or S; $X_6$ is A, K, G, or E; and $X_7$ is Q, M, T, I, or A.

In some instances, the Vα region contains a complementarity determining region 1 (CDR-1) comprising an amino acid sequence set forth in any of SEQ ID NOs: 139, 145, 148, 154, 168, 176, 484, 546, 561, 579, 668, 701, 719, or 751, or a sequence having at least at or about 90, 91, 92, 93, 94, 95, 96, 97, 98, or 99% identity with such a sequence. In some aspects, the Vα region contains a CDR-1 contained within the amino acid sequence set forth in any of SEQ ID NOs: 112, 114, 116, 118, 120, 122, 124, 126, 128, 296, 298, 300, 483, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, 1008, or 1380, or a sequence having at least at or about 90, 91, 92, 93, 94, 95, 96, 97, 98, or 99% identity with such a sequence. In some embodiments, the $V_\alpha$ region contains a complementarity determining region 2 (CDR-2) comprising an amino acid sequence set forth in any of SEQ ID NOs: 140, 149, 155, 169, 177, 485, 547, 562, 580, 669, 702, 720, 752, 918, or 1009, or a sequence having at least at or about 90, 91, 92, 93, 94, 95, 96, 97, 98, or 99% identity with such a sequence. In some embodiments, the $V_\alpha$ region contains a CDR-2 contained within the amino acid sequence set forth in any of SEQ ID NOs: 112, 114, 116, 118, 120, 122, 124, 126, 128, 296, 298, 300, 483, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, 1008, or 1380, or a sequence having at least at or about 90, 91, 92, 93, 94, 95, 96, 97, 98, or 99% identity with such a sequence.

In some embodiments, the Vα region contains the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999, or an amino acid sequence that has at least 90%, 91%, 92%, 93%, 94%, 95%, 96%, 97%, 98%, or 99% sequence identity thereto. In some instances, the Vβ region contains the amino acid sequence set forth in any of SEQ ID NOs: 112, 114, 116, 118, 120, 122, 124, 126, 128, 296, 298, 300, 483, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008, or an amino acid sequence that has at least 90%, 91%, 92%, 93%, 94%, 95%, 96%, 97%, 98%, or 99% sequence identity thereto. In some embodiments, the TCR contains an alpha chain comprising any of such Vα chain sequences and any of such Vβ chain sequences.

In some embodiments, the alpha chain of the TCR or antigen-binding fragment thereof further contains an alpha constant (Cα) region or portion thereof. In some aspects, the beta chain further contains a beta constant (Cβ) region or portion thereof. Thus, in some embodiments, the TCR, e.g., the HPV 16 E6 or E7 TCR or antigen-binding fragment thereof, contains an alpha chain comprising a variable alpha (Vα) region and an alpha constant (Cα) region or portion thereof and/or a beta chain comprising a variable beta (Vβ) region and a beta constant region (Cβ) or portion thereof.

In some cases, the Cα and Cβ regions are mouse constant regions. In some embodiments, the Cα region contains the amino acid sequence set forth in SEQ ID NO: 262 or 317, or a sequence of amino acids that has at least 90% sequence identity thereto, such as a sequence having at least at or about 90, 91, 92, 93, 94, 95, 96, 97, 98, or 99% identity with such a sequence. In some cases, the Cβ region contains the amino acid sequence set forth in SEQ ID NO: 263 or 109, or a sequence of amino acids that has at least 90% sequence identity thereto, such as a sequence having at least at or about 90, 91, 92, 93, 94, 95, 96, 97, 98, or 99% identity with such a sequence.

In some embodiments, the Cα and Cβ regions are human constant regions. In some such embodiments, the Cα region comprises the amino acid sequence set forth in any of SEQ ID NOs: 212, 213, 215, 217, 218, 220, or 524, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region contains the amino acid sequence set forth in SEQ ID NO: 214, 216, 631, or 889, or a sequence of amino acids that has at least 90% sequence identity thereto, such as a sequence having at least at or about 90, 91, 92, 93, 94, 95, 96, 97, 98, or 99% identity with such a sequence.

In some embodiments, the Cα and/or Cβ regions are modified, for example, by incorporation of one or more non-native cysteine residues. In some embodiments, the constant region is a modified form of a human constant region (e.g. modified compared to a Cα region set forth in any of SEQ ID NOs: 212, 213, 215, 217, 218, 220, or 524, and/or a Cβ region set forth in SEQ ID NO:214, 216, 631, or 889. In some embodiments, the modification is by introduction of cysteine at residue Thr48 of the Cα chain and/or Ser57 of the Cβ chain, at residue Thr45 of the Cα chain and/or Ser77 of the Cβ chain, at residue Tyr10 of the Cα chain and/or Ser17 of the Cβ chain, at residue Thr45 of the Cα chain and Asp59 of the Cβ chain and/or at residue Ser15 of the Cα chain and Glu15 of the Cβ chain with reference to numbering of a Cα set forth in any of SEQ ID NOS: 212, 213, 217, 218 or 524 or Cβ set forth in SEQ ID NO: 214 or 216. Corresponding residues can be identified by aligning a reference sequence to any of SEQ ID NOS: 212, 213, 217, 218, 524, 214 or 216. For example, Thr48 in the Cα chain aligns with or corresponds to Thr49 in the sequence set forth in SEQ ID NO: 215 or 220 and Ser57 in the Cβ chain aligns with or corresponds to Ser58 in the sequence set forth in SEQ ID NO:631 or 889. In some such embodiments, the Cα region contains a non-native cysteine at residue 48 (or at a corresponding residue, e.g. residue 49) and comprises the amino acid sequence set forth in any of SEQ ID NOs: 196, 198, 200, 201, 203, 525, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue or residues. In some aspects, the Cβ region contains a non-native cysteine at residue 57 (or at a corresponding residue, e.g. residue 58) and contains the amino acid sequence set forth in SEQ ID NO: 197, 199, 632, 890, or 1363, or a sequence of amino acids that has at least 90% sequence identity thereto, such as a sequence having at least at or about 90, 91, 92, 93, 94, 95, 96, 97, 98, or 99% identity with such a sequence and that contains the non-native cysteine residue or residues.

In some embodiments, the TCR or antigen-binding fragment thereof comprises an alpha chain comprising the sequence of amino acids set forth in SEQ ID NO: 18, 28, 38, 48, 58, 68, 78, 88, 98, 287, or 291 or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 22, 32, 42, 52, 62, 72, 82, 92, 102, 285, 289, 293, 479, 494, 512, 526, 541, 556, 574, 589, 601, 613, 625, 639, 651, 663, 681, 696, 714, 731, 746, 764, 777, 789, 804, 820, 835, 847, 859, 871, 883, 897, 913, 927, 941, 953, 965, 977, 989, 1004 or 1376, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 19, 29, 39, 49, 59, 69, 79, 89, 99, 284, 288, 292, 474, 489, 501, 507, 519, 533, 551, 566, 584, 596, 608, 620, 634, 646, 658, 673, 688, 706, 723, 738, 756, 772, 784, 796, 812, 827, 842, 854, 866, 878, 892, 905, 922, 934, 948, 960, 972, 984, 996, or 1387, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 23, 33, 43, 53, 63, 73, 83, 93, 103, 286, 290, 294, 480, 495, 513, 527, 542, 557, 575, 590, 602, 614, 626, 640, 652, 664, 682, 697, 715, 732, 747, 765, 778, 790, 805, 821, 836, 848, 860, 872, 884, 898, 914, 928, 942, 954, 966, 978, 990, 1005, or 1377, or a sequence of amino acids that has at least 90% sequence identity thereto, such as a sequence having at least at or about 90, 91, 92, 93, 94, 95, 96, 97, 98, or 99% identity with such a sequence.

In some embodiments, the alpha chain and/or beta chain of the TCR is encoded by a sequence of nucleotides comprising a signal peptide (also called a leader sequence). Non-limiting examples of such a signal peptide are signal peptides that have or comprise the sequence of amino acids set forth in any of SEQ ID NOS: 181-182, 184-194, 310, 311, 487, 540, 549, 564, 573, 582, 671, 680, 695, 704, 713, 730, 745, 754, 763, 770, 803, 810, 819, 834, 903, 912, 920, 1003, or 1011. In some embodiments, the TCR or antigen-binding fragment thereof is encoded by a sequence of nucleotides that encodes: a) an alpha chain comprising the sequence of amino acids set forth in SEQ ID NO: 318, 319, 322, 323, 326, 327, 330, 331, 334, 335, 338, 339, 130, 131, 134, 135, 195, 205, 222, 242, 253, 256, 313, 314, 475, 476, 490, 491, 502, 503, 508, 509, 520, 521, 534, 535, 552, 553, 567, 568, 585, 586, 597, 598, 609, 610, 621, 622, 635, 636, 647, 648, 659, 660, 674, 675, 689, 690, 707, 708, 724, 725, 739, 740, 757, 758, 773, 774, 785, 786, 797, 798, 813, 814, 828, 829, 843, 844, 855, 856, 867, 868, 879, 880, 893, 894, 906, 907, 923, 924, 935, 936, 949, 950, 961, 962, 973, 974, 985, 986, 997, 998, 1388, 1389, or a sequence of amino acids that has at least 90% sequence identity thereto, such as a sequence having at least at or about 90, 91, 92, 93, 94, 95, 96, 97, 98, or 99% identity with such a sequence and/or b) a beta chain comprising the sequence of amino acids set forth in SEQ ID NO: 320, 321, 324, 325, 328, 329, 332, 333, 336, 337, 110, 129, 132, 133, 179, 180, 206, 221, 246, 250, 260, 312, 315, 316, 481, 482, 496, 497, 514, 515, 616, 528, 529, 543, 544, 558, 559, 576, 577, 591, 592, 603, 604, 615, 627, 628, 641, 642, 653, 654, 665, 666, 683, 684, 698, 699, 716, 717, 733, 734, 748, 749, 766, 767, 779, 780, 791, 792, 806, 807, 822, 823, 837, 838, 849, 850, 861, 862, 873, 874, 885, 886, 899, 900, 915, 916, 929, 930, 943, 944, 955, 956, 967, 968, 979, 980, 991, 992, 1006, 1007, or 1378-1379, or a sequence of amino acids that has at least 90% sequence identity thereto, such as a sequence having at least at or about 90, 91, 92, 93, 94, 95, 96, 97, 98, or 99% identity with such a sequence. In some embodiments, the alpha chain and beta chain can be connected via a linker, such as any described elsewhere herein.

In some embodiments, the TCR or antigen-binding fragment thereof recognizes or binds to an epitope or region of HPV16 E6, such as a peptide epitope containing an amino acid sequence set forth in any of SEQ ID NOs: 232-234. In some cases, the TCR or antigen-binding fragment thereof does not recognize or bind the epitope E6(29-38) comprising the amino acid sequence TIHDIILECV (SEQ ID NO. 233). In some instances, the TCR or antigen-binding fragment thereof that recognizes or binds a peptide epitope derived from HPV16 E6 is or comprises the sequence set forth in SEQ ID NO: 232 or SEQ ID NO: 234.

In some aspects, the TCR or antigen-binding fragment recognizes or binds to an epitope or region of HPV16 E7 protein, such as a peptide epitope containing an amino acid sequence set forth in any of SEQ ID NOs: 235-239. In some embodiments, the TCR or antigen-binding fragment thereof does not recognize or bind the epitope E7(11-19) comprising the amino acid sequence YMLDLQPET (SEQ ID NO. 236). In some cases, the peptide derived from HPV16 E7 is or contains the sequence set forth in SEQ ID NO: 235.

a. HPV 16 E6(29-38)

In some cases, the TCR recognizes or binds a peptide epitope derived from HPV16 E6 that is or contains E6(29-38) TIHDIILECV (SEQ ID NO: 233). In some embodiments, the TCR recognizes or binds HPV 16 E6 (29-38) in the context of an MHC, such as an MHC class I, e.g. HLA-A2. In some embodiments, the HPV 16 E6 contains the sequence set forth in SEQ ID NO: 264.

In some embodiments, the TCR or antigen-binding fragment thereof contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO: 1370), where $X_1$ is A, I, or V; $X_2$ is M, L, S or V; $X_3$ is R, L, Q or N; $X_4$ is E, V, T, P, G or F; $X_5$ is G, I, L, A, null or P; $X_6$ is R, T, null or S; $X_7$ is G, R, or null; $X_8$ is T, G, or null; $X_9$ is null or A; $X_{10}$ is null or G; $X_{11}$ is null or G; $X_{12}$ is null or T; $X_{13}$ is null or S; $X_{14}$ is G, Y, null or N; $X_{15}$ is F, G, N or T; $X_{16}$ is K, N or P; $X_{17}$ is T or L; and $X_{18}$ is I, F, V or T.

In some embodiments, the TCR or antigen-binding fragment thereof contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{10}X_{17}X_{18}$ (SEQ ID NO: 248), where $X_1$ is A, I, or V; $X_2$ is M, L, S or V; $X_3$ is R, L, Q or N; $X_4$ is E, V, T, P, G or F; $X_5$ is G, I, L, A, null or P; $X_6$ is R, T, G, null or S; $X_7$ is G, R, or null; $X_8$ is T, G, or null; $X_9$ is null or A; $X_{10}$ is null or G; $X_{11}$ is null or G; $X_{12}$ is null or T; $X_{13}$ is null or S; $X_{14}$ is G, Y, null or N; $X_{15}$ is F, G, N or T; $X_{16}$ is K, N or P; $X_{17}$ is T or L; and $X_{18}$ is I, V, F or T.

In some embodiments, the TCR or antigen-binding fragment thereof contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO:1205), where $X_1$ is A, I, or V; $X_2$ is M, L, A, V, S, or E; $X_3$ is R, L, N, S, Q, K, G, or W; $X_4$ is E, V, P, T, F, A, G, N, D, or L; $X_5$ is G, I, D, L, A, P, H, N, R, T, or null; $X_6$ is G, N, R, T, M, S, P, or null; $X_7$ is G, V, D, L, Q, T, R, N, or null; $X_8$ is T, D, S, L, G, or null; $X_9$ is A, G, Q, or null; $X_{10}$ is G, or null; $X_{11}$ is G, or null; $X_{12}$ is T, or null; $X_{13}$ is S, A, T, G, or null; $X_{14}$ is G, Y, T, N, A, W, or null; $X_{15}$ is F, G, N, T, Y, D, S, R, Q, or E; $X_{16}$ is K, P, A, N, D, or Q; $X_{17}$ is L, M, I, V, or T; and $X_{18}$ is I, T, V, N, F, R, or Q.

In some embodiments, the TCR or antigen-binding fragment thereof contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO:1220), where $X_1$ is A, I, or V; $X_2$ is M, L, A, V, S, or E; $X_3$ is R, L, N, S, Q, K, G, or W; $X_4$ is E, V, P, T, F, A, G, N, D, or L; $X_5$ is G, I, D, L, A, P, N, R, T, or null; $X_6$ is G, N, R, T, M, S, P, or null; $X_7$ is G, D, L, Q, T, R, or null; $X_8$ is T, D, S, L, G, or null; $X_9$ is A, G, Q, or null; $X_{10}$ is G, or null; $X_{11}$ is G, or null; $X_{12}$ is T, or null; $X_{13}$ is S, A, T, G, or null; $X_{14}$ is G, Y, T, N, A, W, or null; $X_{15}$ is F, G, N, T, Y, D, S, R, Q, or E; $X_{16}$ is K, P, A, D, or Q; $X_{17}$ is L, M, I, V, or T; and $X_{18}$ is I, T, V, F, R, or Q.

In some embodiments, the TCR or antigen-binding fragment thereof contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}LT$ (SEQ ID NO: 1206), where $X_1$ is A, I, or V; $X_2$ is L, M, V, or E; $X_3$ is L, R, N, G, or S; $X_4$ is V, T, F, N, E, P, G, or L; $X_5$ is I, A, P, N, G, or T; $X_6$ is R, G, S, or T; $X_7$ is G, R, L, V, or T; $X_8$ is T, G, L, or null; $X_9$ is A, G, Q, or null; $X_{10}$ is G, or null; $X_{11}$ is G, or null; $X_{12}$ is T, or null; $X_{13}$ is S, T, or G; $X_{14}$ is Y, A, G, or N; $X_{15}$ is G, S, N, R, or E; and $X_{16}$ is K, or Q.

In some embodiments, the TCR or antigen-binding fragment thereof contains a Vα region that contains a complementarity determining region 3 (CDR-3) comprising the amino acid sequence $AMRX4X_5X_6X_7X_8X_9X_{10}X_{11}X_{12}X_{13}X_{14}X_{15}$ (SEQ ID NO:1207), where $X_4$ is E, T, A, D, or L; $X_5$ is G, A, N, or R; $X_6$ is R, G, R, T, M, or S; $X_7$ is G, V, D, L, or null; $X_8$ is T, D, or null; $X_9$ is G, or null; $X_{10}$ is S, T, G, or null; $X_{11}$ is G, Y, N, A, or W; $X_{12}$ is F, G, N, D, S, or Y; $X_{13}$ is K, D, Q; $X_{14}$ is T, L, M, or I; and $X_{15}$ is I, T, R, or Q.

In some embodiments, the TCR or antigen-binding fragment thereof contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO:1208), where $X_1$ is I, or V; $X_2$ is L, or V; $X_3$ is L, N, or R; $X_4$ is V, F, or G; $X_5$ is I, P, G, or T; $X_6$ is R, S, P, or G; $X_7$ is G, R, Q, T, or V; $X_8$ is T, G, S, or L; $X_9$ is A, G, Q, or null; $X_{10}$ is G, or null; $X_{11}$ is G, or null; $X_{12}$ is T, or null; $X_{13}$ is G, or S; $X_{14}$ is Y, or N; $X_{15}$ is G, Q, or E; $X_{17}$ is V, or L; and $X_{18}$ is I, or T.

In some embodiments, the TCR or antigen-binding fragment thereof contains a Vα region that contains a complementarity determining region 3 (CDR-3) comprising the amino acid sequence $AX_2RX_4AX_6NNDMR$ (SEQ ID NO:1221), where $X_2$ is V, or M; $X_4$ is P, or D; $X_6$ is N, or R.

In some embodiments, the Vα region contains a complementarity determining region 1 (CDR-1) comprising the amino acid sequence $X_1X_2X_3X_4X_5X_6X_7$ (SEQ ID NO: 1371), where $X_1$ is T, D, or N; $X_2$ is I, or S; $X_3$ is S, D, or A; $X_4$ is G, Q, P, or null; $X_5$ is T, S, or I; $X_6$ is D, Y, or Q; and $X_7$ is Y, G, N, or Q. In some embodiments, the Vα region contains a complementarity determining region 1 (CDR-1) comprising the amino acid sequence $X_1X_2X_3X_4X_5X_6X_7$ (SEQ ID NO: 240), where $X_1$ is T, D, S or N; $X_2$ is I, or S; $X_3$ is S, D, N, Y or A; $X_4$ is G, Q, P, or null; $X_5$ is T, S, F or I; $X_6$ is D, Y, P or Q; and $X_7$ is Y, G, N, A, S or Q. In some embodiments, the Vα region contains a complementarity determining region 1 (CDR-1) comprising the amino acid sequence $X_1X_2X_3X_4X_5X_6X_7$ (SEQ ID NO: 1209), where $X_1$ is T, N, D, or S; $X_2$ is S, I, or R; $X_3$ is D, S, M, A, Y, N, or G; $X_4$ is Q, G, P, or null; $X_5$ is S, T, F, I, or N; $X_6$ is Y, D, Q, P, N, or E; and $X_7$ is G, Y, N, S, or A.

In some examples, the Vα region contains a complementarity determining region 2 (CDR-2) comprising the amino acid sequence $X_1X_2X_3X_4X_5X_6X_7X_8$ (SEQ ID NO: 1372), where $X_1$ is G, Q, I, or V; $X_2$ is L, S, Q, or Y; $X_3$ is T, G, or S; $X_4$ is Y, S, or null; $X_5$ is null or D; $X_6$ is null, E, Q, or S; $X_7$ is S, Q, R, or G; and $X_8$ is N or E. In some examples, the Vα region contains a complementarity determining region 2 (CDR-2) comprising the amino acid sequence $X_1X_2X_3X_4X_5X_6X_7X_8$ (SEQ ID NO: 244), where $X_1$ is G, Q, I, M, Y or V; $X_2$ is L, S, Q, T or Y; $X_3$ is T, G, L or S; $X_4$ is Y, S, N, A or null; $X_5$ is null, A, or D; $X_6$ is null, E, Q, T or S; $X_7$ is S, Q, R, L or G; and $X_8$ is N, V or E. In some examples, the Vα region contains a complementarity determining region 2 (CDR-2) comprising the amino acid sequence $X_1X_2X_3X_4X_5X_6X_7X_8$ (SEQ ID NO:1210), where $X_1$ is Q, G, I, V, Y, M, R, or N; $X_2$ is G, L, S, Q, Y, T, N, or V; $X_3$ is S, T, L, or K; $X_4$ is Y, I, S, A, N, F, or null; $X_5$ is D, A, or null; $X_6$ is E, K, Q, S, T, G, D, or null; $X_7$ is Q, S, N, R, G, L, or D; and $X_8$ is N, K, E, V, or L.

In some aspects, the TCR or antigen-binding fragment thereof contains a Vβ region that contains a complementarity determining region 3 (CDR-3) comprising the amino acid sequence $ASSX_4X_5X_6X_7X_8X_9X_{10}X_{11}X_{12}X_{13}$ (SEQ ID NO: 1373), where $X_4$ is H, P, L, or Y; $X_5$ is L, G, W, F, or S; $X_6$ is A, G, or L; $X_7$ is G, E, A, T, or null; $X_8$ is F, G, T, or S;

$X_9$ is T, N, H, or A; $X_{10}$ is G, T, Q, D, or Y; $X_{11}$ is E, P, T, or G; $X_{12}$ is L, A, Q, or Y; and $X_{13}$ is F, H, Y, or T.

In some aspects, the TCR or antigen-binding fragment thereof contains a Vβ region that contains a complementarity determining region 3 (CDR-3) comprising the amino acid sequence ASX$_3$X$_4$X$_5$X$_6$X$_7$X$_8$X$_9$X$_{10}$X$_{11}$X$_{12}$X$_{13}$ (SEQ ID NO: 258), where $X_3$ is S or T; $X_4$ is H, P, L, F or Y; $X_5$ is L, G, W, F, T or S; $X_6$ is A, G, or L; $X_7$ is G, E, A, T, Q or null; $X_8$ is F, G, T, R or S; $X_9$ is T, N, H, R, E or A; $X_{10}$ is G, T, Q, D, R or Y; $X_{11}$ is E, P, T, or G; $X_{12}$ is L, A, Q, or Y; and $X_{13}$ is F, H, Y, or T.

In some aspects, the TCR or antigen-binding fragment thereof contains a Vβ region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}$ (SEQ ID NO: 1211), where $X_1$ is A, S, or V; $X_2$ is S, A, or V; $X_3$ is S, V, R, or Q; $X_4$ is H, P, Q, L, Y, G, T, F, S, R, or E; $X_5$ is L, G, R, W, F, S, V, T, Y, Q, or null; $X_6$ is A, G, L, T, E, P, or null; $X_7$ is G, T, A, R, Q, N, S, or null; $X_8$ is G, S, or null; $X_9$ is G, or null; $X_{10}$ is F, G, A, S, T, R, Q, L, or null; $X_{11}$ is T, N, F, A, R, S, G, or null; $X_{12}$ is G, T, L D, Y, N, Q, S, or E; $X_{13}$ is E, W, T, G, K, N, or P; $X_{14}$ is L, A, K, Q, Y, or I; and $X_{15}$ is F, H, Y, T, or I.

In some aspects, the TCR or antigen-binding fragment thereof contains a Vβ region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}$ (SEQ ID NO: 1222), where $X_1$ is A, S, or V; $X_2$ is S, A, or V; $X_3$ is S, R, or Q; $X_4$ is H, P, Q, L, Y, G, T, F, S, R, or E; $X_5$ is L, G, R, W, F, S, V, T, Y, Q, or null; $X_6$ is A, G, L, E, P, or null; $X_7$ is G, T, A, R, Q, N, S, or null; $X_8$ is G, S, or null; $X_9$ is G, or null; $X_{10}$ is F, G, A, S, T, R, Q, L, or null; $X_{11}$ is T, N, F, A, R, S, G, or null; $X_{12}$ is G, T, L D, Y, N, Q, S, or E; $X_{13}$ is E, W, T, G, K, N, or P; $X_{14}$ is L, A, K, Q, Y, or I; and $X_{15}$ is F, H, Y, T, or I.

In some aspects, the TCR or antigen-binding fragment thereof contains a Vβ region that contains a complementarity determining region 3 (CDR-3) comprising the amino acid sequence ASSX$_4$X$_5$X$_6$X$_7$X$_8$X$_9$X$_{10}$X$_{11}$X$_{12}$X$_{13}$X$_{14}$ (SEQ ID NO: 1212), where $X_4$ is H, P, Q, L, Y, F, R, or E; $X_5$ is L, G, R, W, F, S, V, T, Y, or Q; $X_6$ is A, G, L, E P; $X_7$ is G, T, A, R, Q, S, or null; $X_8$ is G, S, or null; $X_9$ is F, G, A, S, T, R, L, or null; $X_{10}$ is T, N, A, F, R, S, or G; $X_{11}$ is G, T, L, D, Y, Q, S, E, or N; $X_{12}$ is E, W, T, G, P, K; $X_{13}$ is L, A, K, Q, Y, or I; and $X_{15}$ is F, H, Y, or T.

In some aspects, the TCR or antigen-binding fragment thereof contains a Vβ region that contains a complementarity determining region 3 (CDR-3) comprising the amino acid sequence $X_1X_2X_3X_4X_5X_6X_7X_8X_9X_{10}X_{11}X_{12}X_{13}$QY (SEQ ID NO: 1213), where $X_1$ is A, or S; $X_2$ is S, V, or A; $X_3$ is S, or V; $X_4$ is L, Y, P, or S; $X_5$ is W, F, V, L, or Y; $X_6$ is G, T, or A; $X_7$ is A, R, Q, S, or null; $X_8$ is G, or null; $X_9$ is G, or null; $X_{10}$, is S, T, R, or G; $X_{11}$ is T, A, R, S, or N; $X_{12}$ is D, Y, T, or G; and $X_{13}$ is T, or E.

In some aspects, the TCR or antigen-binding fragment thereof contains a Vβ region that contains a complementarity determining region 3 (CDR-3) comprising the amino acid sequence $X_1X_2SX_4X_5X_6X_7X_8X_9X_{10}X_{11}X_{12}X_{13}$QY (SEQ ID NO: 1223), where $X_1$ is A, or S; $X_2$ is S, or A; $X_4$ is L, Y, P, or S; $X_5$ is W, F, V, L, or Y; $X_6$ is G, or A; $X_7$ is A, R, Q, S, or null; $X_8$ is G, or null; $X_9$ is G, or null; $X_{10}$ is S, T, R, or G; $X_{11}$ is T, A, R, S, or N; $X_{12}$ is D, Y, T, or G; and $X_{13}$ is T, or E.

In some aspects, the TCR or antigen-binding fragment thereof contains a Vβ region that contains a complementarity determining region 3 (CDR-3) comprising the amino acid sequence ASX$_3$X$_4$X$_5$X$_6$X$_7$X$_8$X$_9$X$_{10}$X$_{11}$X$_{12}$F (SEQ ID NO: 1214), where $X_3$ is S, Q, or R; $X_4$ is H, P, T, or E; $X_5$ is L, G, W, or F; $X_6$ is A, G, or null; $X_7$ is G, N, S, R, or null; $X_8$ is F, G, Q, L, A, or null; $X_9$ is T, N, or A; $X_{10}$ is G, T, N, or E; $X_{11}$ is E, N, or K; and $X_{12}$ is L, A, or Q.

In some aspects, the TCR or antigen-binding fragment thereof contains a Vβ region that contains a complementarity determining region 3 (CDR-3) comprising the amino acid sequence ASSX$_4$X$_5$X$_6$X$_7$X$_8$NYX$_{11}$YT (SEQ ID NO: 1215), where $X_4$ is L, or R; $X_5$ is S, or T; $X_6$ is G, T, or A; $X_7$ is T, or null; $X_8$ is G, or null; and $X_{11}$ is G, or null.

In some aspects, the TCR or antigen-binding fragment thereof contains a Vβ region that contains a complementarity determining region 3 (CDR-3) comprising the amino acid sequence ASSX$_4$WGX$_7$SNQPX$_{12}$H (SEQ ID NO:1216), where $X_4$ is L, F, or P; $X_7$ is R, or Q; and $X_{12}$ is Q, or L.

In some aspects, the TCR or antigen-binding fragment thereof contains a Vβ region that contains a complementarity determining region 3 (CDR-3) comprising the amino acid sequence ASSX$_4$X$_5$X$_6$X$_7$X$_8$SGNTIY (SEQ ID NO:1217), where $X_4$ is L, or R; $X_5$ is W, or Q; $X_6$ is G, or P; $X_7$ is R, or S; and $X_8$ is S, or null.

In some instances, the Vβ region contains a complementarity determining region 1 (CDR-1) comprising the amino acid sequence $X_1X_2HX_4X_5$ (SEQ ID NO: 252), where $X_1$ is S or M; $X_2$ is G, E, D, or N; $X_4$ is V, N, or E; and $X_5$ is S, R, N, or Y. In some instances, the Vβ region contains a complementarity determining region 1 (CDR-1) comprising the amino acid sequence $X_1X_2X_3X_4X_5X_6$ (SEQ ID NO: 1218), where $X_1$ is S, M, D, or L; $X_2$ is G, E, D, N, Q, S, or F; $X_3$ is H, V, Y, N, or Q; $X_4$ is A, S, F, or null; $X_5$ is W V, N, E, T, P, Y, K, D, or L; and $X_6$ is S, R, A, N, Y, M, or T.

In some cases, the Vβ region contains a complementarity determining region 2 (CDR-2) comprising the amino acid sequence $X_1X_2X_3X_4X_5X_6$ (SEQ ID NO: 255), where $X_1$ is F or S; $X_2$ is Q, Y, or V; $X_3$ is N, D, or G; $X_4$ is E or V; $X_5$ is A, K, or G; and $X_6$ is Q, M, or T. In some cases, the Vβ region contains a complementarity determining region 2 (CDR-2) comprising the amino acid sequence $X_1X_2X_3X_4X_5X_6X_7$ (SEQ ID NO: 1219), where $X_1$ is F, Y, S, A M; $X_2$ is N, Q, V, T, Y, or A; $X_3$ is N, D, E, S, G, I, F, Q, or L; $X_4$ is G, A, N, or null; $X_5$ is E, K, V, E, S, T, G, or N; $X_6$ is A, E, K, G, L, D, V, or N; and $X_7$ is Q, M, T, A, V, E, P, D, or I.

In some embodiments, the Vα region contains a complementary determining region 3 (CDR-3) comprising an amino acid sequence set forth in any of SEQ ID NOs: 138, 144, 147, 163, 167, 173, 304, 308, 478, 493, 505, 511, 523, 539, 555, 572, 588, 600, 612, 624, 638, 650, 662, or 679, or a sequence having at least at or about 90, 91, 92, 93, 94, 95, 96, 97, 98, or 99% identity with such a sequence. In some examples, the Vα region contains a CDR3 contained within the amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676, or a sequence having at least at or about 90, 91, 92, 93, 94, 95, 96, 97, 98, or 99% identity with such a sequence. In some embodiments, the Vα region further contains a complementarity determining region 1 (CDR-1) comprising an amino acid sequence set forth in any of SEQ ID NOs: 136, 142, 161, 165 171, 302, 306, 537, 570, or 677, or a sequence having at least at or about 90, 91, 92, 93, 94, 95, 96, 97, 98, or 99% identity with such a sequence. In some aspects, the Vα region contains a CDR-1 contained within the amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676, or a sequence having at least at or about 90, 91, 92, 93, 94, 95, 96, 97, 98, or 99% identity with such a sequence. In some embodiments, the Vα region further contains a complementarity determining region 2 (CDR-2) comprising an amino acid sequence set forth in any of SEQ ID NOs: 137, 143, 162, 166, 172, 303, 307, 538, 571, or 678, or a sequence having at least at or about 90, 91, 92, 93, 94, 95, 96, 97, 98, or 99% identity with such a sequence. In some cases, the Vα region contains a CDR-2 contained within the amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676, or a sequence having at least at or about 90, 91, 92, 93, 94, 95, 96, 97, 98, or 99% identity with such a sequence.

In some embodiments, the Vβ region contains a complementarity determining region 3 (CDR-3) comprising an amino acid sequence set forth in any of SEQ ID NOs: 141, 146, 150, 164, 170 174, 305, 309, 486, 499, 517, 531, 548, 563, 581, 594, 606, 618, 630, 644, 656, 670, or 686, or a CDR3 contained within the amino acid sequence set forth in any of SEQ ID NOs: 112, 114, 116, 122, 124 126, 298, 300, 483, 498, 516, 530, 545, 560, 578, 593, 605, 617, 629, 643, 655, 667, or 685, or a sequence having at least at or about 90, 91, 92, 93, 94, 95, 96, 97, 98, or 99% identity with such a sequence. In some embodiments, the Vβ region contains a complementarity determining region 1 (CDR-1) comprising an amino acid sequence set forth in any of SEQ ID NOs: 139, 145, 148, 168, 484, 546, 561, 579, or 668, or a sequence having at least at or about 90, 91, 92, 93, 94, 95, 96, 97, 98, or 99% identity with such a sequence. In some instances, the Vβ region contains a CDR-1 contained within the amino acid sequence set forth in any of SEQ ID NOs: 112, 114, 116, 122, 124 126, 298, 300, 483, 498, 516, 530, 545, 560, 578, 593, 605, 617, 629, 643, 655, 667, or 685, or a sequence having at least at or about 90, 91, 92, 93, 94, 95, 96, 97, 98, or 99% identity with such a sequence. In some embodiments, the V13 region further contains a complementarity determining region 2 (CDR-2) comprising an amino acid sequence set forth in any of SEQ ID NOs: 140, 149, 169, 485, 547, 562, 580, or 669, or a sequence having at least at or about 90, 91, 92, 93, 94, 95, 96, 97, 98, or 99% identity with such a sequence. In some examples, the Vβ region contains a CDR-2 contained within the amino acid sequence set forth in any of SEQ ID NOs: 112, 114, 116, 122, 124 126, 298, 300, 483, 498, 516, 530, 545, 560, 578, 593, 605, 617, 629, 643, 655, 667, or 685, or a sequence having at least at or about 90, 91, 92, 93, 94, 95, 96, 97, 98, or 99% identity with such a sequence.

In some embodiments, the TCR or antigen-binding fragment thereof contains a Vα region that contains a complementarity determining region 1 (CDR-1) comprising an amino acid sequence set forth in any of SEQ ID NOs: 136, 142, 161, 165, 171, 302, 306, 537, 570, or 677, a complementarity determining region 2 (CDR-2) comprising an amino acid sequence set forth in any of SEQ ID NOs: 137, 143, 162, 166, 172, 303, 307, 538, 571, or 678, and/or a complementarity determining region 3 (CDR-3) comprising an amino acid sequence set forth in any of SEQ ID NOs: 138, 144, 147, 163, 167 173, 304, 308, 478, 493, 505, 511, 523, 539, 555, 572, 588, 600, 612, 624, 638, 650, 662, or 679. Also among the provided TCRs are those having sequences at least at or about 90, 91, 92, 93, 94, 95, 96, 97, 98, or 99% identical to such sequences. In some aspects, the TCR or antigen-binding fragment thereof contains a Vβ region that contains a complementarity determining region 1 (CDR-1) comprising an amino acid sequence set forth in any of SEQ ID NOs: 139, 145, 148, 168, 484, 546, 561, 579, or 668, a complementarity determining region 2 (CDR-2) comprising an amino acid sequence set forth in any of SEQ ID NOs: 140, 149, 169, 485, 547, 562, 580, or 669, and/or a complementarity determining region 3 (CDR-3) comprising an amino acid sequence set forth in any of SEQ ID NOs: 141, 146, 150, 164, 170 174, 305, 309, 486, 499, 517, 531, 548, 563, 581, 594, 606, 618, 630, 644, 656, 670, or 686. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 138, respectively. In some such embodiments, the Vβ region contains a CDR-1, CDR-2, and CDR-3, comprising the amino acid sequences of SEQ ID NOs: 139, 140, and 141, respectively. Also among the provided TCRs are those having sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 142, 143, and 144, respectively. In some such embodiments, the Vβ region contains a CDR-1, CDR-2, and CDR-3, comprising the amino acid sequences of SEQ ID NOs: 145, 140, and 146, respectively. Also among the provided TCRs are those having sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 136, 137, and 147, respectively. In some such embodiments, the Vβ region contains a CDR-1, CDR-2, and CDR-3, comprising the amino acid sequences of SEQ ID NOs: 148, 149, and 150, respectively. Also among the provided TCRs are those containing sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 161, 162, and 163, respectively. In some such embodiments, the Vβ region contains a CDR-1, CDR-2, and CDR-3, comprising the amino acid sequences of SEQ ID NOs: 148, 149, and 164, respectively. Also among the provided TCRs are those containing sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 165, 166, and 167, respectively. In some such embodiments, the Vβ region contains a CDR-1, CDR-2, and CDR-3, comprising the amino acid sequences of SEQ ID NOs: 168, 169, and 170, respectively. Also among the provided TCRs are those containing sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 171, 172, and 173, respectively. In some such embodiments, the Vβ region contains a CDR-1, CDR-2, and CDR-3, comprising the amino acid sequences of SEQ ID NOs: 148, 149, and 174, respectively. Also among the provided TCRs are those containing sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 302, 303, and 304, respectively. In some such embodiments, the Vβ region contains a CDR-1, CDR-2, and CDR-3, comprising the amino acid sequences of SEQ ID NOs: 139, 140, and 305, respectively. Also among the provided TCRs are those containing sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 306, 307, and 308, respectively. In some such embodiments, the Vβ region contains a CDR-1, CDR-2, and CDR-3, comprising the amino acid sequences of SEQ ID NOs: 148, 149, and 309, respectively. Also among the provided TCRs are those containing sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 478, respectively. In some such embodiments, the Vβ region contains a CDR-1, CDR-2, and CDR-3, comprising the amino acid sequences of SEQ ID NOs: 484, 485, and 486, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 161, 162, and 493, respectively. In some such embodiments, the Vβ region contains a CDR-1, CDR-2, and CDR-3, comprising the amino acid sequences of SEQ ID NOs: 148, 149, and 499, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 165, 166, and 505, respectively. In some such embodiments, the Vβ region contains a CDR-1, CDR-2, and CDR-3, comprising the amino acid sequences of SEQ ID NOs: 148, 149, and 499, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 161, 162, and 511, respectively. In some such embodiments, the Vβ region contains a CDR-1, CDR-2, and CDR-3, comprising the amino acid sequences of SEQ ID NOs: 148, 149, and 517, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 523, respectively. In some such embodiments, the Vβ region contains a CDR-1, CDR-2, and CDR-3, comprising the amino acid sequences of SEQ ID NOs: 148, 149, and 531, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 537, 538, and 539, respectively. In some such embodiments, the Vβ region contains a CDR-1, CDR-2, and CDR-3, comprising the amino acid sequences of SEQ ID NOs: 546, 547, and 548, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 555, respectively. In some such embodiments, the Vβ region contains a CDR-1, CDR-2, and CDR-3, comprising the amino acid sequences of SEQ ID NOs: 561, 562, and 563, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 570, 571, and 572, respectively. In some such embodiments, the Vβ region contains a CDR-1, CDR-2, and CDR-3, comprising the amino acid sequences of SEQ ID NOs: 579, 580, and 581, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 588, respectively. In some such embodiments, the Vβ region contains a CDR-1, CDR-2, and CDR-3, comprising the amino acid sequences of SEQ ID NOs: 148, 149, and 594, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 600, respectively. In some such embodiments, the Vβ region contains a CDR-1, CDR-2, and CDR-3, comprising the amino acid sequences of SEQ ID NOs: 148, 149, and 606, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 612, respectively. In some such embodiments, the Vβ region contains a CDR-1, CDR-2, and CDR-3, comprising the amino acid sequences of SEQ ID NOs: 148, 149, and 618, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 624, respectively. In some such embodiments, the Vβ region contains a CDR-1, CDR-2, and CDR-3, comprising the amino acid sequences of SEQ ID NOs: 168, 169, and 630, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 142, 143, and 638, respectively. In some such embodiments, the Vβ region contains a CDR-1, CDR-2, and CDR-3, comprising the amino acid sequences of SEQ ID NOs: 561, 562, and 644, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 171, 172, and 650, respectively. In some such embodiments, the Vβ region contains a CDR-1, CDR-2, and CDR-3, comprising the amino acid sequences of SEQ ID NOs: 148, 149, and 656, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 662, respectively. In some such embodiments, the Vβ region contains a CDR-1, CDR-2, and CDR-3, comprising the amino acid sequences of SEQ ID NOs: 668, 669, and 670, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 677, 678, and 679, respectively. In some such embodiments, the Vβ region contains a CDR-1, CDR-2, and CDR-3, comprising the amino acid sequences of SEQ ID NOs: 154, 155, and 686, respectively. Also among the provided TCRs are those having sequences at least at or about 90, 91, 92, 93, 94, 95, 96, 97, 98, or 99% identical to such sequences.

In some embodiments, the Vα region contains a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676. In some aspects, the Vβ region contains a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 112, 114, 116, 122, 124 126, 298, 300, 483, 498, 516, 530, 545, 560, 578, 593, 605, 617, 629, 643, 655, 667, or 685. Also among the provided TCRs are those containing sequences at least at or about 90, 91, 92, 93, 94, 95, 96, 97, 98, or 99% identical to such sequences.

In some embodiments, the TCR or antigen-binding fragment includes a Vα region that contains a complementarity determining region 1 (CDR-1), a CDR-2, and a CDR-3, respectively comprising the CDR-1, CDR-2, and CDR-3 amino acid sequences set forth in Table 2; and a Vβ region that contains a complementarity determining region 1 (CDR-1), a CDR-2, and a CDR-3, respectively comprising the CDR-1, CDR-2, and CDR-3 amino acid sequences set forth in Table 2. Also among the provided TCRs are those containing sequences at least at or about 90, 91, 92, 93, 94, 95, 96, 97, 98, or 99% identical to such sequences. Exemplary TCRs containing such CDRs, or their modified versions as described elsewhere herein, also are set forth in the Table 2.

TABLE 2

HPV16 E6(29-38) TCR CDR SEQ ID NOs.

| Exemplary TCR | Alpha | | | Beta | | |
|---|---|---|---|---|---|---|
| | CDR1 | CDR2 | CDR3 | CDR1 | CDR2 | CDR3 |
| TCR 3 | 136 | 137 | 138 | 139 | 140 | 141 |
| TCR 4 | 142 | 143 | 144 | 145 | 140 | 146 |
| TCR 5 | 136 | 137 | 147 | 148 | 149 | 150 |
| TCR 8 | 161 | 162 | 163 | 148 | 149 | 164 |
| TCR 9 | 165 | 166 | 167 | 168 | 169 | 170 |
| TCR 10 | 171 | 172 | 173 | 148 | 149 | 174 |
| TCR 13 | 302 | 303 | 304 | 139 | 140 | 305 |
| TCR 14 | 306 | 307 | 308 | 148 | 149 | 309 |
| TCR 15 | 136 | 137 | 478 | 484 | 485 | 486 |
| TCR 16 | 161 | 162 | 493 | 148 | 149 | 499 |
| TCR 17 | 165 | 166 | 505 | 148 | 149 | 499 |
| TCR 18 | 161 | 162 | 511 | 148 | 149 | 517 |
| TCR 19 | 136 | 137 | 523 | 148 | 149 | 531 |
| TCR 20 | 537 | 538 | 539 | 546 | 547 | 548 |
| TCR 21 | 136 | 137 | 555 | 561 | 562 | 563 |
| TCR 22 | 570 | 571 | 572 | 579 | 580 | 581 |
| TCR 23 | 136 | 137 | 588 | 148 | 149 | 594 |
| TCR 24 | 136 | 137 | 600 | 148 | 149 | 606 |
| TCR 25 | 136 | 137 | 612 | 148 | 149 | 618 |
| TCR 26 | 136 | 137 | 624 | 168 | 169 | 630 |
| TCR 27 | 142 | 143 | 638 | 561 | 562 | 644 |
| TCR 28 | 171 | 172 | 650 | 148 | 149 | 656 |
| TCR 29 | 136 | 137 | 662 | 668 | 669 | 670 |
| TCR 30 | 677 | 678 | 679 | 154 | 155 | 686 |

In some instances, the TCR or antigen-binding fragment thereof contains Vα and Vβ regions containing the amino acid sequences of SEQ ID NOs: 111 and 112, respectively. In some embodiments, the Vα and Vβ regions contain the amino acid sequences of SEQ ID NOs: 113 and 114, respectively. In some cases, the Vα and Vβ regions contain the amino acid sequences of SEQ ID NOs: 115 and 116, respectively. In some embodiments, the Vα and Vβ regions contain the amino acid sequences of SEQ ID NOs: 121 and 122, respectively. In some aspects, the Vα and Vβ regions contain the amino acid sequences of SEQ ID NOs: 123 and 124, respectively. In some examples, the Vα and Vβ regions contain the amino acid sequences of SEQ ID NOs: 125 and 126, respectively. In some examples, the Vα and Vβ regions contain the amino acid sequences of SEQ ID NOs: 297 and 298, respectively. In some examples, the Vα and Vβ regions contain the amino acid sequences of SEQ ID NOs: 299 and 300, respectively. In some embodiments, the Vα and Vβ regions contain the amino acid sequences of SEQ ID NOs: 477 and 483, respectively. In some examples, the Vα and Vβ regions contain the amino acid sequences of SEQ ID NOs: 492 and 498, respectively. In some cases, the Vα and Vβ regions contain the amino acid sequences of SEQ ID NOs: 504 and 498, respectively. In some instances, the TCR or antigen-binding fragment thereof contains Vα and Vβ regions containing the amino acid sequences of SEQ ID NOs: 510 and 516, respectively. In some embodiments, the Vα and Vβ regions contain the amino acid sequences of SEQ ID NOs: 522 and 530, respectively. In some examples, the Vα and Vβ regions contain the amino acid sequences of SEQ ID NOs: 536 and 545, respectively. In some cases, the Vα and Vβ regions contain the amino acid sequences of SEQ ID NOs: 554 and 560, respectively. In some instances, the TCR or antigen-binding fragment thereof contains Vα and Vβ regions containing the amino acid sequences of SEQ ID NOs: 569 and 578, respectively. In some embodiments, the Vα and Vβ regions contain the amino acid sequences of SEQ ID NOs: 587 and 593, respectively. In some examples, the Vα and Vβ regions contain the amino acid sequences of SEQ ID NOs: 599 and 605, respectively. In some embodiments, the Vα and Vβ regions contain the amino acid sequences of SEQ ID NOs: 611 and 617, respectively. In some cases, the Vα and Vβ regions contain the amino acid sequences of SEQ ID NOs: 623 and 629, respectively. In some instances, the Vα and Vβ regions contain the amino acid sequences of SEQ ID NOs: 637 and 643, respectively. In some cases, the Vα and Vβ regions contain the amino acid sequences of SEQ ID NOs: 649 and 655, respectively. In some examples, the Vα and Vβ regions contain the amino acid sequences of SEQ ID NOs: 661 and 667, respectively. In some cases, the Vα and Vβ regions contain the amino acid sequences of SEQ ID NOs: 676 and 685, respectively. Also among the provided TCRs are those containing sequences at least at or about 90, 91, 92, 93, 94, 95, 96, 97, 98, or 99% identical to such sequences.

In some embodiments, the alpha chain of the TCR or antigen-binding fragment thereof further contains a Cα region or portion thereof and/or the beta chain further contains a Cβ region or portion thereof. In some embodiments, the Cα region or portion thereof comprises the amino acid sequence set forth in any of SEQ ID NOs: 212, 213, 215, 218, or 524, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region contains the amino acid sequence set forth in SEQ ID NO: 214, 216, or 631, or a sequence of amino acids that has at least 90% sequence identity thereto, such as a sequence having at least at or about 90, 91, 92, 93, 94, 95, 96, 97, 98, or 99% identity with such a sequence. In some embodiments, the Cα and/or Cβ regions are modified, for example, by incorporation of one or more non-native cysteine residues, such as any described herein. In some embodiments, the Cα region or portion thereof contains a non-native cysteine at residue 48 and comprises the amino acid sequence set forth in any of SEQ ID NOs: 196, 198, 201, 203, or 525, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue (e.g. Cys48). In some aspects, the Cβ region contains a non-native cysteine at residue 57 and contains the amino acid sequence set forth in SEQ ID NO: 197, 199, or 632, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 18, 28, 38, 68, 78, 88, 287, 291, 473, 488, 500, 506, 518, 532, 550, 565, 583, 595, 607, 619, 633, 645, 657, or 672, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 22, 32, 42, 72, 82, 92, 289, 293, 479, 494, 512, 526, 541, 556, 574, 589, 601, 613, 625, 639, 651, 663, or 681, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 19, 29, 39, 69, 79, 89, 288, 292, 474, 489, 501, 507, 519, 533, 551, 566, 584, 596, 608, 620, 634, 646, 658, or 673, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 23, 33, 43, 73, 83, 93, 290, 294, 480, 495, 513, 527, 542, 557, 575, 590, 602, 614, 626, 640, 652, 664, or 682, or a sequence of amino acids that has at least 90% sequence identity thereto, such as a sequence having at least at or about 90, 91, 92, 93, 94, 95, 96, 97, 98, or 99% identity with such a sequence.

In some embodiments, the Vα and Vβ regions contain the amino acid sequences corresponding to the SEQ ID NOs. set forth in Table 3 or Table 4. In some aspects, the TCR contains constant alpha and constant beta region sequences, such as those corresponding to the SEQ ID NOs. set forth in Table 3 or Table 4. In some cases, the TCR contains a full sequence comprising the variable and constant chain, such as a sequence corresponding to the SEQ ID NOs. set forth in Tables 3 or 4("Full"). In some embodiments, the full sequence containing the variable and constant regions also includes a signal sequence and thus comprises a sequence corresponding to the SEQ ID NOs. set forth in Table 3 or 4 ("Full+signal"). Also among the provided TCRs are those containing sequences at least at or about 90, 91, 92, 93, 94, 95, 96, 97, 98, or 99% identical to such sequences. Exemplary TCRs containing such sequences, or their modified versions as described elsewhere herein, also are set forth in the Tables 3 and 4, respectively.

TABLE 3

HPV16 E6(29-38) TCR Native SEQ ID NOs.

| | Alpha | | | | Beta | | | |
|---|---|---|---|---|---|---|---|---|
| Exemplary TCR | Variable (Vα) | Constant | Full | Full + signal | Variable (Vβ) | Constant | Full | Full + signal |
| TCR 3 | 111 | 215 | 18 | 318 | 112 | 216 | 22 | 320 |
| TCR 4 | 113 | 213 | 28 | 322 | 114 | 214 | 32 | 324 |
| TCR 5 | 115 | 213 | 38 | 326 | 116 | 214 | 42 | 328 |
| TCR 8 | 121 | 213 | 68 | 338 | 122 | 216 | 72 | 110 |
| TCR 9 | 123 | 213 | 78 | 130 | 124 | 216 | 82 | 132 |
| TCR 10 | 125 | 212 | 88 | 134 | 126 | 214 | 92 | 179 |
| TCR 13 | 297 | 213 | 287 | 253 | 298 | 216 | 289 | 260 |
| TCR 14 | 299 | 218 | 291 | 313 | 300 | 214 | 293 | 315 |
| TCR 15 | 477 | 218 | 473 | 475 | 483 | 216 | 479 | 481 |
| TCR 16 | 492 | 213 | 488 | 490 | 498 | 214 | 494 | 496 |
| TCR 17 | 504 | 213 | 500 | 502 | 498 | 214 | 494 | 496 |
| TCR 18 | 510 | 213 | 506 | 508 | 516 | 214 | 512 | 514 |
| TCR 19 | 522 | 524 | 518 | 520 | 530 | 216 | 526 | 528 |
| TCR 20 | 536 | 218 | 532 | 534 | 545 | 216 | 541 | 543 |
| TCR 21 | 554 | 213 | 550 | 552 | 560 | 214 | 556 | 558 |
| TCR 22 | 569 | 524 | 565 | 567 | 578 | 214 | 574 | 576 |
| TCR 23 | 587 | 524 | 583 | 585 | 593 | 214 | 589 | 591 |
| TCR 24 | 599 | 524 | 595 | 597 | 605 | 216 | 601 | 603 |
| TCR 25 | 611 | 524 | 607 | 609 | 617 | 214 | 613 | 615 |
| TCR 26 | 623 | 213 | 619 | 621 | 629 | 631 | 625 | 627 |
| TCR 27 | 637 | 213 | 633 | 635 | 643 | 214 | 639 | 641 |
| TCR 28 | 649 | 213 | 645 | 647 | 655 | 214 | 651 | 653 |
| TCR 29 | 661 | 524 | 657 | 659 | 667 | 216 | 663 | 665 |
| TCR 30 | 676 | 213 | 672 | 674 | 685 | 214 | 681 | 683 |

TABLE 4

HPV16 E6(29-38) TCR Modified SEQ ID NOs.

| Exemplary modified version of TCR | Alpha | | | | Beta | | | |
|---|---|---|---|---|---|---|---|---|
| | Variable (Vα) | Constant | Full | Full + signal | Variable (Vβ) | Constant | Full | Full + signal |
| TCR 3 | 111 | 198 | 19 | 319 | 112 | 199 | 23 | 321 |
| TCR 4 | 113 | 196 | 29 | 323 | 114 | 197 | 33 | 325 |
| TCR 5 | 115 | 196 | 39 | 327 | 116 | 197 | 43 | 329 |
| TCR 8 | 121 | 203 | 69 | 339 | 122 | 199 | 73 | 129 |
| TCR 9 | 123 | 203 | 79 | 131 | 124 | 199 | 83 | 133 |
| TCR 10 | 125 | 198 | 89 | 135 | 126 | 197 | 93 | 180 |
| TCR 13 | 297 | 203 | 288 | 256 | 298 | 199 | 290 | 312 |
| TCR 14 | 299 | 201 | 292 | 314 | 300 | 197 | 294 | 316 |
| TCR 15 | 477 | 201 | 474 | 476 | 483 | 199 | 480 | 482 |
| TCR 16 | 492 | 203 | 489 | 491 | 498 | 197 | 495 | 497 |
| TCR 17 | 504 | 203 | 501 | 503 | 498 | 197 | 495 | 497 |
| TCR 18 | 510 | 203 | 507 | 509 | 516 | 197 | 513 | 515 |
| TCR 19 | 522 | 525 | 519 | 521 | 530 | 199 | 527 | 529 |
| TCR 20 | 536 | 201 | 533 | 535 | 545 | 199 | 542 | 544 |
| TCR 21 | 554 | 203 | 551 | 553 | 560 | 197 | 557 | 559 |
| TCR 22 | 569 | 525 | 566 | 568 | 578 | 197 | 575 | 577 |
| TCR 23 | 587 | 525 | 584 | 586 | 593 | 197 | 590 | 592 |
| TCR 24 | 599 | 203 | 596 | 598 | 605 | 199 | 602 | 604 |
| TCR 25 | 611 | 525 | 608 | 610 | 617 | 197 | 614 | 616 |
| TCR 26 | 623 | 203 | 620 | 622 | 629 | 632 | 626 | 628 |
| TCR 27 | 637 | 203 | 634 | 636 | 643 | 197 | 640 | 642 |
| TCR 28 | 649 | 203 | 646 | 648 | 655 | 197 | 652 | 654 |
| TCR 29 | 661 | 525 | 658 | 660 | 667 | 199 | 664 | 666 |
| TCR 30 | 676 | 203 | 673 | 675 | 685 | 197 | 682 | 684 | b. HPV 16 E7(11-19)

In some cases, the TCR recognizes or binds a peptide epitope derived from HPV 16 E7 that is or contains E7(11-19) YMLDLQPET (SEQ ID NO: 236). In some embodiments, the TCR recognizes or binds HPV 16 E7(11-19) in the context of an MHC, such as an MHC class I, e.g., HLA-A2. In some embodiments, the HPV 16 E7 contains the sequence set forth in SEQ ID NO: 265.

In some embodiments, the TCR or antigen-binding fragment thereof contains a Vα region containing a complementarity determining region 3 (CDR-3) comprising the amino acid sequence $X_1X_2X_3X_4X_5X_6X_7X_8X_9X_{10}X11$ (SEQ ID NO: 249), where $X_1$ is A or V; $X_2$ is E or V; $X_3$ is S or P; $X_4$ is I, S or R; $X_5$ is R, G or D; $X_6$ is G, A or N; $X_7$ is F, null or Y; $X_8$ is G or T; $X_9$ is T, Q or N; $X_{10}$ is V, K or N; $X_{11}$ is L or F, and $X_{12}$=H, I, or V. In some embodiments, the TCR or antigen-binding fragment thereof contains a Vα region containing a complementarity determining region 3 (CDR-3) comprising the amino acid sequence $X_1X_2SX_4X_5X_6X_7X_8X_9X_{10}X_{11}$ (SEQ ID NO: 1374), where $X_1$ is A or V; $X_2$ is E or V; $X_4$ is I or R; $X_5$ is R or D; $X_6$ is G or N; $X_7$ is F or Y; $X_8$ is N or Q; $X_9$ is V or N; $X_{10}$ is L or F; and $X_{11}$ is H or V.

In some embodiments, the TCR or antigen-binding fragment thereof contains a Vα region containing a complementarity determining region 3 (CDR-3) comprising the amino acid sequence $X_1X_2X_3X_4X_5X_6X_7X_8X_9X_{10}X_{11}X_{12}X_{13}X_{14}$ (SEQ ID NO:1183), where $X_1$ is V, or A; $X_2$ is V, A, G, Q, M, or E; $X_3$ is S, G, A, N, Y, R, T, or P; $X_4$ is E, A, S, G, R. F, N, D, V, P, L, I, or M; $X_5$ is R, N, H, T, D, G, S, A, P, L, Q, or F; $X_6$ is G, H, N, A, S, L, T, or null; $X_7$ is T, S, G, or null; $X_8$ is G, or null; $X_9$ is G, Y, N, S, or null; $X_{10}$ is T, G, S, D, F, Y, A, N, or null; $X_{11}$ is Y, F, Y, Q, N, or R; $X_{12}$ is N, K, Q, or D; $X_{13}$ is Y, L, T, F, M, or V; and $X_{14}$ is I, T, S, V, R, or Y.

In some embodiments, the TCR or antigen-binding fragment thereof contains a Vα region containing a complementarity determining region 3 (CDR-3) comprising the amino acid sequence $VVX_3X_4X_5X_6X_7X_8GX_{10}X_{11}X_{12}X_{13}$ (SEQ ID NO:1184), where $X_3$ is S, N, or T; $X_4$ is R, or F; $X_5$ is D, or A; $X_6$ is N, or L; $X_7$ is T, or null; $X_8$ is Y, or G; $X_{10}$ is Q, or F; $X_{11}$ is N, or K; $X_{12}$ is F, or T; and $X_{13}$ is V, or I.

In some embodiments, the TCR or antigen-binding fragment thereof contains a Vα region containing a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO:1185), where $X_2$ is A, G, V, Q, M, or E; $X_3$ is S, G, N, A, Y, R, or P; $X_4$ is E, S, A, G, F, N, D, V, P, L, I, M, or R; $X_5$ is R, N, H, T, D, G, S, P, L, Q, or F; $X_6$ is G, H, A, S, T, or null; $X_7$ is T, S, G, or null; $X_8$ is G, or null; $X_9$ is G, N, S, or null; $X_{10}$ is T, G, S, D, F, Y, A, or N; $X_{11}$ is Y, F, Q, R, or N; $X_{12}$ is K, Q, or D; $X_{13}$ is Y, L, T, M, F, or V; and $X_{14}$ is I, T, S, R, Y, or V.

In some embodiments, the TCR or antigen-binding fragment thereof contains a Vα region containing a complementarity determining region 3 (CDR-3) comprising the amino acid sequence $X_1X_2X_3X_4X_5X_6X_7X_8X_9X_{10}KX_{12}1$ (SEQ ID NO:1186), where $X_1$ is A, or V; $X_2$ is A, V, or E; $X_3$ is S, N, T, R, or P; $X_4$ is E, A, G, F, V, P, I, D, or S; $X_5$ is R, H, T, A P, S, G, or F; $X_6$ is G, H, L, T, S, A, or null; $X_7$ is S, T, or null; $X_8$ is G, or null; $X_9$ is G, T, or null; $X_{10}$ is F, Y, or N; and $X_{12}$ is Y, T, or L.

In some embodiments, the TCR or antigen-binding fragment thereof contains a Vα region containing a complementarity determining region 3 (CDR-3) comprising the amino acid sequence $AX_2X_3X_4X_5X_6X_7X_8X_9YKYI$ (SEQ ID NO:1187), where $X_2$ is A, V, or E; $X_3$ is S, N, or R; $X_4$ is E, G, V, P, I, or D; $X_5$ is R, T, P, S, G, or F; $X_6$ is G, T, S, or null; $X_7$ is S, or null; $X_8$ is G, or null; and $X_9$ is T, or null.

In some embodiments, the TCR or antigen-binding fragment thereof contains a Vα region containing a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO:1188), where $X_2$ is G, V, Q, or M; $X_3$ is G, A, Y, S, N, or R; $X_4$ is S, G, L, I, M, or R; $X_5$ is N, D, G, S, L, Q, or R; $X_6$ is A, S, G, or null; $X_7$ is G, or null; $X_8$ is G, or null; $X_9$ is G, N, S, or null; $X_{10}$ is S, D, Y, A, N, or null; $X_{11}$ is Y, Q, or R; $X_{12}$ is K, or Q; $X_{13}$ is L, or V; and $X_{14}$ is S, T, or V.

In some embodiments, the TCR or antigen-binding fragment thereof contains a Vα region containing a complementarity determining region 3 (CDR-3) comprising the amino acid sequence $AX_2X_3X_4X_5X_6X_7X_8X_9X_{10}X_{11}X_{12}X_{13}T$ (SEQ ID NO:1189), where $X_2$ is G, V, or Q; $X_3$ is G, Y, S, or N; $X_4$ is S, L, or M; $X_5$ is N, G, L, or R; $X_6$ is A, S, G, or null; $X_7$ is G, or null; $X_8$ is G, or null; $X_9$ is G, S, or null; $X_{10}$ is S, Y, A, N, or null; $X_{11}$ is Y, Q, or R; $X_{12}$ is K, or Q; and $X_{13}$ is L, or V.

In some embodiments, the TCR or antigen-binding fragment thereof contains a Vα region containing a complementarity determining region 3 (CDR-3) comprising the amino acid sequence $AX_2X_3X_4X_5X_6X_7YKLS$ (SEQ ID NO: 1190), where $X_2$ is G, or V; $X_3$ is A, or Y; $X_4$ is G, S, or R; $X_5$ is D, or S; $X_6$ is N, or null; and $X_7$ is D, or null.

In some embodiments, the Vα region contains a complementarity determining region 1 (CDR-1) comprising the amino acid sequence $X_1SX_3X_4X_5X_6$ (SEQ ID NO: 241), where $X_1$ is D or V; $X_3$ is S, or P; $X_4$ is S or F; $X_5$ is T or S; and $X_6$ is Y or N. In some embodiments, the Vα region contains a complementarity determining region 1 (CDR-1) comprising the amino acid sequence $X_1X_2X_3X_4X_5X_6$ (SEQ ID NO:1191), where $X_1$ is N, S, D, T, or V; $X_2$ is S, V, R, T, or I; $X_3$ is M, F, G, S, N, A, L, V, or P; $X_4$ is F, S, N, A, or null; $X_5$ is D, S, Q, Y, N, V, T, or P; and $X_6$ is Y, S, R, N, G, or T.

In some cases, the Vα region contains a complementarity determining region 2 (CDR-2) comprising the amino acid sequence $X_1X_2X_3X_4X_5X_6X_7$ (SEQ ID NO: 245), where $X_1$ is I or M; $X_2$ is F or T; $X_3$ is S or F; $X_4$ is N or S; $X_5$ is M or E; $X_6$ is D or N; and $X_7$ is M or T. In some embodiments, the Vα region contains a complementarity determining region 2 (CDR-2) comprising the amino acid sequence $X_1X_2X_3X_4X_5X_6X_7X_8$ (SEQ ID NO:1192), where $X_1$ is I, V, L, G, N, T, Y, or M; $X_2$ is S, V, Y, L, P, F, I, or T; $X_3$ is S, Y, K, L, T, or F; $X_4$ is I, G, N, A, S, or null; $X_5$ is S, D, or null; $X_6$ is K, G, N, S, D, T, or E; $X_7$ is D, E, G, A, K, L, or N; and $X_8$ is K, V, D, P, N, T, L, or M.

In some aspects, the TCR or antigen-binding fragment thereof contains a Vβ region containing a complementarity determining region 3 (CDR-3) comprising the amino acid sequence $AX_2TX_4RX_6X_7YX_9X_{10}X_{11}$ (SEQ ID NO: 259), where $X_2$ is S or I; $X_4$ is T or D; $X_6$ is S or T; $X_7$ is S or N; $X_9$ is E or G; $X_{10}$ is Q or Y; and $X_{11}$ is Y or T.

In some embodiments, the TCR or antigen-binding fragment thereof contains a Vβ region containing a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO: 1193), where $X_2$ is S, M, I, K, or V; $X_3$ is S, T, N, or A; $X_4$ is R, V P, 5, T, G, L, A, I, or D; $X_5$ is F, G, R, Y, 5, L, V, or T; $X_6$ is L, G, D, A, 5, T, V, R, or null; $X_7$ is G, D, R, S, T, or null; $X_8$ is S, or null; $X_9$ is S, H, G, R, V, T, D, L, or null; $X_{10}$ is T, S, A, Y, N, G, or P; $X_{11}$ is D, Y, N, E, K, or G; $X_{12}$ is T, E, G, or K; $X_{13}$ is Q, Y, A, or L; and $X_{14}$ is Y, F, T, or I.

In some embodiments, the TCR or antigen-binding fragment thereof contains a Vβ region containing a complementarity determining region 3 (CDR-3) comprising the amino acid sequence $AX_2TX_4X_5X_6X_7X_8X_9X_{10}X_{11}X_{12}$ (SEQ ID NO: 1194), where $X_2$ is S, M, I, or K; $X_4$ is P, T, G, A, S, or D; $X_5$ is R, or S; $X_6$ is D, G, S, T, or V; $X_7$ is R, S, or null; $X_8$ is T, Y, G, N, or S; $X_9$ is Y, N, or K; $X_{10}$ is E, or G; $X_{11}$ is Q, A, or Y; and $X_{12}$ is Y, F, or T.

In some embodiments, the TCR or antigen-binding fragment thereof contains a Vβ region containing a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO: 1195), where $X_2$ is S, M, I, or K; $X_3$ is S, T, A, or N; $X_4$ is R, V, S, P, T, G, L, or A; $X_5$ is F, G, R, Y, S, V, or T; $X_6$ is L, G, D, A, S, T, V, or null; $X_7$ is G, D, R, T, or null; $X_8$ is S, or null; $X_9$ is S, H, G, R, V, T, L, or null; $X_{10}$ is T, S, Y, A, N, G, or P; $X_{11}$ is D, Y, N, K, E, or G; $X_{12}$ is T, or E; $X_{13}$ is Q, A, or L; and $X_{14}$ is Y, or F.

In some embodiments, the TCR or antigen-binding fragment thereof contains a Vβ region containing a complementarity determining region 3 (CDR-3) comprising the amino acid sequence $AX_2X_3X_4X_5X_6X_7X_8X_9X_{10}X_{11}QY$ (SEQ ID NO: 1196), where $X_2$ is S, M, I, or K; $X_3$ is S, T, A, or N; $X_4$ is R, P, S, G, L, A, or T; $X_5$ is F, R, Y, V, or T; $X_6$ is L, D, A, S, T, V, or null; $X_7$ is G, R, or null; $X_8$ is S, G, V, or null; $X_9$ is T, A, G, N, S, or P; $X_{10}$ is D, Y, or E; and $X_{11}$ is T, or E.

In some embodiments, the TCR or antigen-binding fragment thereof contains a Vβ region containing a complementarity determining region 3 (CDR-3) comprising the amino acid sequence $AX_2X_3X_4X_5X_6X_7X_8X_9$1 YEQY (SEQ ID NO: 1197), where $X_2$ is S, M, I, or K; $X_3$ is S, T, A, or N; $X_4$ is P, S, G, T, or A; $X_5$ is R, or Y; $X_6$ is D, A, S, T, or V; $X_7$ is R, or null; $X_8$ is G, V, or null; and $X_9$ is S, T, A, or N.

In some embodiments, the TCR or antigen-binding fragment thereof contains a Vβ region containing a complementarity determining region 3 (CDR-3) comprising the amino acid sequence $ASTX_4X_5X_6X_7X_8X_9X_{10}X_{11}EX_{13}X_{14}$ (SEQ ID NO: 1198), where $X_4$ is T, P, or G; $X_5$ is R, or S; $X_6$ is S, D, G, or V; $X_7$ is D, or null; $X_8$ is S, or null; $X_9$ is S, R, or null; $X_{10}$ is S, T, Y, or G; $X_{11}$ is Y, N, or K; $X_{13}$ is Q, or A; and $X_{14}$ is Y, or F.

In some embodiments, the TCR or antigen-binding fragment thereof contains a Vβ region containing a complementarity determining region 3 (CDR-3) comprising the amino acid sequence $AX_2X_3X_4X_5X_6X_7X_8YGYT$ (SEQ ID NO: 1199), where $X_2$ is S, or I; $X_3$ is S, or T; $X_4$ is L, A, or D; $X_5$ is L, T, or R; $X_6$ is L, T, or R; $X_7$ is G, D, or null; and $X_8$ is A, or N.

In some embodiments, the TCR or antigen-binding fragment thereof contains a Vβ region containing a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO: 1200), where $X_2$ is 5, V, or I; $X_3$ is S, N, or A; $X_4$ is R, V, S, L, P, G, I, or A; $X_5$ is F, G, Y, L, V, R, T, or S; $X_6$ is L, G, A, D, R, V, or null; $X_7$ is G, D, R, S, T, or null; $X_8$ is S, or null; $X_9$ is S, H, G, V, T, D, L, or null; $X_{10}$ is T, S, A, G, P, N, or Y; $X_{11}$ is D, Y, E, G, or N; $X_{12}$ is T, E, G, or K; $X_{13}$ is Q, Y, or L; and $X_{14}$ is Y, F, T, or I.

In some embodiments, the TCR or antigen-binding fragment thereof contains a Vβ region containing a complementarity determining region 3 (CDR-3) comprising the amino acid sequence $ASSX_4X_5X_6X_7X_8X_9X_{10}X_{11}X_{12}X_{13}X_{14}$ (SEQ ID NO: 1201), where $X_4$ is R, V, S, L, G, or A; $X_5$ is F, G, Y, L, V, T, or S; $X_6$ is A, L, R, D, G, or null; $X_7$ is G, D, T, or null; $X_8$ is S, or null; $X_9$ is S, H, G, T, D, L, or null; $X_{10}$ is T, S, A, G, P, N, or Y; $X_{11}$ is D, Y, E, G, or N; $X_{12}$ is T, E, G, or T; $X_{13}$ is Q, Y, or L; and $X_{14}$ is Y, F, or T.

In some embodiments, the TCR or antigen-binding fragment thereof contains a Vβ region containing a complementarity determining region 3 (CDR-3) comprising the amino acid sequence $ASSX_4X_5X_6X_7X_8X_9X_{10}TQY$ (SEQ ID NO: 1202), where $X_4$ is R, L, or G; $X_5$ is F, V, T, or Y; $X_6$ is L, A, or null; $X_7$ is G, or null; $X_8$ is S, G, or null; $X_9$ is T, G, P, or S; and $X_{10}$ is D, or E.

In some embodiments, the Vβ region contains a complementarity determining region 1 (CDR-1) comprising the amino acid sequence $SX_2X_3X_4X_5$ (SEQ ID NO:1203), where $X_2$ is G, or N; $X_3$ is H, or D; $X_4$ is T, L, N, or V; and $X_5$ is A, S, Y, or T.

In some embodiments, the Vβ region contains a complementarity determining region 2 (CDR-2) comprising the amino acid sequence $X_1X_2X_3X_4X_5X_6$ (SEQ ID NO:1204), where $X_1$ is F, or Y; $X_2$ is Q, Y, or N; $X_3$ is G, N, R, or Y; $X_4$ is N, G, E, or T; $X_5$ is S, E, A, or G; and $X_6$ is A, E, I, or Q.

In some aspects, the Vβ region contains a complementarity determining region 1 (CDR-1) comprising the amino acid sequence set forth in SEQ ID NO: 154, 701, 719, or 751. In some embodiments, the Vβ region contains a complementarity determining region 2 (CDR-2) comprising the amino acid sequence set forth in SEQ ID NO: 155, 702, 720, 752, 918, or 1009.

In some embodiments, the Vα region contains a complementarity determining region 3 (CDR-3) comprising the amino acid sequence set forth in any of SEQ ID NOs: 153, 159, 301, 694, 712, 729, 744, 762, 776, 788, 802, 818, 832, 846, 858, 870, 882, 896, 911, 926, 940, 952, 964, 976, 988, 1002, or 1391 or a CDR3 contained within the amino acid sequence set forth in any of SEQ ID NOs: 117, 119, 295, 691, 709, 726, 741, 759, 775, 787, 799, 815, 830, 845, 857, 869, 881, 895, 908, 925, 937, 951, 963, 975, 987, 999, or 1390. In some embodiments, the Vα region contains a CDR3 sequence at least at or about 90, 91, 92, 93, 94, 95, 96, 97, 98, or 99% identical to such sequences.

In some embodiments, the Vα region further contains a complementarity determining region 1 (CDR-1) comprising an amino acid sequence set forth in any of SEQ ID NOs: 151, 157, 171, 692, 710, 727, 742, 760, 800, 816, 909, 938, or 1000, or a sequence having at least at or about 90, 91, 92, 93, 94, 95, 96, 97, 98, or 99% identity with such a sequence. In some aspects, the Vα region further contains a complementarity determining region 2 (CDR-2) comprising an amino acid sequence set forth in any of SEQ ID NOs: 152, 158, 172, 693, 711, 728, 743, 761, 801, 817, 831, 910, 939, or 1001, or a sequence having at least at or about 90, 91, 92, 93, 94, 95, 96, 97, 98, or 99% identity with such a sequence.

In some aspects, the Vβ region contains a complementarity determining region 3 (CDR-3) comprising an amino acid sequence set forth in any of SEQ ID NOs: 156, 160, 703, 721, 736, 753, 769, 782, 794, 809, 825, 840, 852, 864, 876, 888, 902, 919, 932, 946, 958, 970, 982, 994, 1010, or 1381, or a CDR3 contained within the amino acid sequence set forth in any of SEQ ID NOs: 118, 120, 296, 700, 718, 735, 750, 768, 781, 793, 808, 824, 839, 851, 863, 875, 887, 901, 917, 931, 945, 957, 969, 981, 993, 1008, 1380. In some embodiments, the Vβ region contains a CDR3 sequence at least at or about 90, 91, 92, 93, 94, 95, 96, 97, 98, or 99% identical to such sequences. In some embodiments, the Vβ region contains a complementarity determining region 1 (CDR-1) comprising the amino acid sequence set forth in SEQ ID NO: 154, 701, 719, or 751, or a sequence having at least at or about 90, 91, 92, 93, 94, 95, 96, 97, 98, or 99% identity with such a sequence. In some instances, the Vβ region contains a complementarity determining region 2 (CDR-2) comprising the amino acid sequence set forth in SEQ ID NO: 155, 702, 720, 752, 918, or 1009, or a sequence having at least at or about 90, 91, 92, 93, 94, 95, 96, 97, 98, or 99% identity with such a sequence.

In some embodiments, the TCR or antigen-binding fragment thereof contains a Vα region that contains a CDR-1, CDR-2, and CDR-3, comprising the amino acid sequences of SEQ ID NOs: 151, 152, and 153, respectively. In some such embodiments, the Vβ region contains a CDR-1, CDR-2, and CDR-3, comprising the amino acid sequences of SEQ ID NOs: 154, 155, and 156, respectively. Also among the provided TCRs are those having sequences at least at or about 90, 91, 92, 93, 94, 95, 96, 97, 98, or 99% identical to such sequences.

In some aspects, the Vα region contains a CDR-1, CDR-2, and CDR-3, comprising the amino acid sequences of SEQ ID NOs: 157, 158, and 159, respectively. In some such aspects, the Vβ region contains a CDR-1, CDR-2, and CDR-3, comprising the amino acid sequences of SEQ ID NOs: 154, 155, and 160, respectively. Also among the provided TCRs are those having sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 151, 152, and 301, respectively. In some such embodiments, the Vβ region contains a CDR-1, CDR-2, and CDR-3, comprising the amino acid sequences of SEQ ID NOs: 154, 155, and 156, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 692, 693, and 694, respectively. In some such embodiments, the Vβ region contains a CDR-1, CDR-2, and CDR-3, comprising the amino acid sequences of SEQ ID NOs: 701, 702, and 703, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 710, 711, and 712, respectively. In some such embodiments, the Vβ region contains a CDR-1, CDR-2, and CDR-3, comprising the amino acid sequences of SEQ ID NOs: 719, 720, and 721, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 727, 728, and 729, respectively. In some such embodiments, the Vβ region contains a CDR-1, CDR-2, and CDR-3, comprising the amino acid sequences of SEQ ID NOs: 154, 155, and 736, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 742, 743, and 744, respectively. In some such embodiments, the Vβ region contains a CDR-1, CDR-2, and CDR-3, comprising the amino acid sequences of SEQ ID NOs: 751, 752, and 753, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 760, 761, and 762, respectively. In some such embodiments, the Vβ region contains a CDR-1, CDR-2, and CDR-3, comprising the amino acid sequences of SEQ ID NOs: 719, 720, and 769, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 171, 172, and 776, respectively. In some such embodiments, the Vβ region contains a CDR-1, CDR-2, and CDR-3, comprising the amino acid sequences of SEQ ID NOs: 154, 155, and 782, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 742, 743, and 788, respectively. In some such embodiments, the Vβ region contains a CDR-1, CDR-2, and CDR-3, comprising the amino acid sequences of SEQ ID NOs: 139, 140, and 794, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 800, 801, and 802 respectively. In some such embodiments, the Vβ region contains a CDR-1, CDR-2, and CDR-3, comprising the amino acid sequences of SEQ ID NOs: 751, 752, and 809, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 816, 817, and 818, respectively. In some such embodiments, the Vβ region contains a CDR-1, CDR-2, and CDR-3, comprising the amino acid sequences of SEQ ID NOs: 154, 155, and 825, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 816, 831, and 832, respectively. In some such embodiments, the Vβ region contains a CDR-1, CDR-2, and CDR-3, comprising the amino acid sequences of SEQ ID NOs: 154, 155, and 840, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 171, 172, and 846, respectively. In some such embodiments, the Vβ region contains a CDR-1, CDR-2, and CDR-3, comprising the amino acid sequences of SEQ ID NOs: 154, 155, and 852, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 816, 831 and 858, respectively. In some such embodiments, the Vβ region contains a CDR-1, CDR-2, and CDR-3, comprising the amino acid sequences of SEQ ID NOs: 154, 155, and 864, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 727, 728, and 870, respectively. In some such embodiments, the Vβ region contains a CDR-1, CDR-2, and CDR-3, comprising the amino acid sequences of SEQ ID NOs: 154, 155, and 876, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 570, 571, and 882, respectively. In some such embodiments, the Vβ region contains a CDR-1, CDR-2, and CDR-3, comprising the amino acid sequences of SEQ ID NOs: 719, 720, and 888, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 816, 817, and 896, respectively. In some such embodiments, the Vβ region contains a CDR-1, CDR-2, and CDR-3, comprising the amino acid sequences of SEQ ID NOs: 701, 702, and 902, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 909, 910, and 911, respectively. In some such embodiments, the Vβ region contains a CDR-1, CDR-2, and CDR-3, comprising the amino acid sequences of SEQ ID NOs: 701, 918, and 919, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 727, 728, and 926, respectively. In some such embodiments, the Vβ region contains a CDR-1, CDR-2, and CDR-3, comprising the amino acid sequences of SEQ ID NOs: 154, 155, and 932, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 938, 939, and 940, respectively. In some such embodiments, the Vβ region contains a CDR-1, CDR-2, and CDR-3, comprising the amino acid sequences of SEQ ID NOs: 154, 155, and 946, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 727, 728, and 952, respectively. In some such embodiments, the Vβ region contains a CDR-1, CDR-2, and CDR-3, comprising the amino acid sequences of SEQ ID NOs: 154, 155, and 958, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 151, 152, and 964, respectively. In some such embodiments, the Vβ region contains a CDR-1, CDR-2, and CDR-3, comprising the amino acid sequences of SEQ ID NOs: 719, 720, and 970, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 727, 728, and 976, respectively. In some such embodiments, the Vβ region contains a CDR-1, CDR-2, and CDR-3, comprising the amino acid sequences of SEQ ID NOs: 154, 155, and 982, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 710, 711, and 988, respectively. In some such embodiments, the Vβ region contains a CDR-1, CDR-2, and CDR-3, comprising the amino acid sequences of SEQ ID NOs: 719, 720, and 994, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 1000, 1001, and 1002, respectively. In some such embodiments, the Vβ region contains a CDR-1, CDR-2, and CDR-3, comprising the amino acid sequences of SEQ ID NOs: 139, 1009, and 1010, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 171, 172, and 1391, respectively. In some such embodiments, the Vβ region contains a CDR-1, CDR-2, and CDR-3, comprising the amino acid sequences of SEQ ID NOs: 154, 155, and 1381, respectively. Also among the provided TCRs are those having sequences at least at or about 90, 91, 92, 93, 94, 95, 96, 97, 98, or 99% identical to such sequences.

In some instances, the Vα region contains a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 117, 119, 295, 691, 709, 726, 741, 759, 775, 787, 799, 815, 830, 845, 857, 869, 881, 895, 908, 925, 937, 951, 963, 975, 987, 999, or 1390. In some cases, the Vβ region contains a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 118, 120, 296, 700, 718, 735, 750, 768, 781, 793, 808, 824, 839, 851, 863, 875, 887, 901, 917, 931, 945, 957, 969, 981, 993, 1008, or 1380. Also among the provided TCRs are those containing sequences at least at or about 90, 91, 92, 93, 94, 95, 96, 97, 98, or 99% identical to such sequences.

In some embodiments, the TCR or antigen-binding fragment includes a Vα region that contains a complementarity determining region 1 (CDR-1), a CDR-2, and a CDR-3, respectively comprising the CDR-1, CDR-2, and CDR-3 amino acid sequences set forth in Table 5 and a Vβ region that contains a complementarity determining region 1 (CDR-1), a CDR-2, and a CDR-3, respectively comprising the CDR-1, CDR-2, and CDR-3 amino acid sequences set forth in Table 5. Also among the provided TCRs are those containing sequences at least at or about 90, 91, 92, 93, 94, 95, 96, 97, 98, or 99% identical to such sequences. Exemplary TCRs containing such CDRs, or their modified versions as described elsewhere herein, also are set forth in the Table 5.

TABLE 5

HPV16 E7(11-19) TCR CDR SEQ ID NOs.

| Exemplary TCR | Alpha | | | Beta | | |
|---|---|---|---|---|---|---|
| | CDR1 | CDR2 | CDR3 | CDR1 | CDR2 | CDR3 |
| TCR 6 | 151 | 152 | 153 | 154 | 155 | 156 |
| TCR 7 | 157 | 158 | 159 | 154 | 155 | 160 |
| TCR 12 | 151 | 152 | 301 | 154 | 155 | 156 |
| TCR 31 | 692 | 693 | 694 | 701 | 702 | 703 |
| TCR 32 | 710 | 711 | 712 | 719 | 720 | 721 |
| TCR 33 | 727 | 728 | 729 | 154 | 155 | 736 |
| TCR 34 | 742 | 743 | 744 | 751 | 752 | 753 |
| TCR 35 | 760 | 761 | 762 | 719 | 720 | 769 |
| TCR 36 | 171 | 172 | 776 | 154 | 155 | 782 |
| TCR 37 | 742 | 743 | 788 | 139 | 140 | 794 |
| TCR 38 | 800 | 801 | 802 | 751 | 752 | 809 |
| TCR 39 | 816 | 817 | 818 | 154 | 155 | 825 |
| TCR 40 | 816 | 831 | 832 | 154 | 155 | 840 |
| TCR 41 | 171 | 172 | 846 | 154 | 155 | 852 |
| TCR 42 | 816 | 831 | 858 | 154 | 155 | 864 |
| TCR 43 | 727 | 728 | 870 | 154 | 155 | 876 |
| TCR 44 | 570 | 571 | 882 | 719 | 720 | 888 |
| TCR 45 | 816 | 817 | 896 | 701 | 702 | 902 |
| TCR 46 | 909 | 910 | 911 | 701 | 918 | 919 |
| TCR 47 | 727 | 728 | 926 | 154 | 155 | 932 |
| TCR 48 | 938 | 939 | 940 | 154 | 155 | 946 |
| TCR 49 | 727 | 728 | 952 | 154 | 155 | 958 |
| TCR 50 | 151 | 152 | 964 | 719 | 720 | 970 |
| TCR 51 | 727 | 728 | 976 | 154 | 155 | 982 |
| TCR 52 | 710 | 711 | 988 | 719 | 720 | 994 |
| TCR 53 | 1000 | 1001 | 1002 | 139 | 1009 | 1010 |
| TCR 54 | 157 | 158 | 159 | 154 | 155 | 160 |
| TCR 55 | 151 | 152 | 301 | 154 | 155 | 156 |
| TCR 66 | 171 | 172 | 1391 | 154 | 155 | 1381 |

In some embodiments, the TCR or antigen-binding fragment thereof contains Vα and Vβ regions containing the amino acid sequences of SEQ ID NOs: 117 and either 118 or 296, respectively. In some aspects, the Vα and Vβ regions contain the amino acid sequences of SEQ ID NOs: 119 and 120, respectively. In some aspects, the Vα and Vβ regions contain the amino acid sequences of SEQ ID NOs: 295 and either 118 or 296, respectively. Also among the provided TCRs are those containing sequences at least at or about 90, 91, 92, 93, 94, 95, 96, 97, 98, or 99% identical to such sequences. In some cases, the Vα and Vβ regions contain the amino acid sequences of SEQ ID NOs: 691 and 700, respectively. In some instances, the Vα and Vβ regions contain the amino acid sequences of SEQ ID NOs: 709 and 718, respectively. In some aspects, the Vα and Vβ regions contain the amino acid sequences of SEQ ID NOs: 726 and 735, respectively. In some embodiments, the Vα and Vβ regions contain the amino acid sequences of SEQ ID NOs: 741 and 750, respectively. In some cases, the Vα and Vβ regions contain the amino acid sequences of SEQ ID NOs: 759 and 768, respectively. In some aspects, the Vα and Vβ regions contain the amino acid sequences of SEQ ID NOs: 775 and 781, respectively. In some embodiments, the Vα and Vβ regions contain the amino acid sequences of SEQ ID NOs: 787 and 793, respectively. In some examples, the Vα and Vβ regions contain the amino acid sequences of SEQ ID NOs: 799 and 808, respectively. In some cases, the Vα and Vβ regions contain the amino acid sequences of SEQ ID NOs: 815 and 824, respectively. In some instances, the Vα and Vβ regions contain the amino acid sequences of SEQ ID NOs: 830 and 839, respectively. In some embodiments, the Vα and Vβ regions contain the amino acid sequences of SEQ ID NOs: 845 and 851, respectively. In some aspects, the Vα and Vβ regions contain the amino acid sequences of SEQ ID NOs: 857 and 863, respectively. In some cases, the Vα and Vβ regions contain the amino acid sequences of SEQ ID NOs: 869 and 875, respectively. In some instances, the Vα and Vβ regions contain the amino acid sequences of SEQ ID NOs: 881 and 887, respectively. In some embodiments, the Vα and Vβ regions contain the amino acid sequences of SEQ ID NOs: 895 and 901, respectively. In some aspects, the Vα and Vβ regions contain the amino acid sequences of SEQ ID NOs: 908 and 917, respectively. In some cases, the Vα and Vβ regions contain the amino acid sequences of SEQ ID NOs: 925 and 931, respectively. In some instances, the Vα and Vβ regions contain the amino acid sequences of SEQ ID NOs: 937 and 945, respectively. In some examples, the Vα and Vβ regions contain the amino acid sequences of SEQ ID NOs: 951 and 957, respectively. In some cases, the Vα and Vβ regions contain the amino acid sequences of SEQ ID NOs: 963 and 969, respectively. In some instances, the Vα and Vβ regions contain the amino acid sequences of SEQ ID NOs: 975 and 981, respectively. In some cases, the Vα and Vβ regions contain the amino acid sequences of SEQ ID NOs: 987 and 993, respectively. In some embodiments, the Vα and Vβ regions contain the amino acid sequences of SEQ ID NOs: 999 and 1008, respectively. In some embodiments, the Vα and Vβ regions contain the amino acid sequences of SEQ ID NOs: 1390 and 1380, respectively.

In some embodiments, the alpha chain of the TCR or antigen-binding fragment thereof further contains a Cα region or portion thereof and/or the beta chain further contains a Cβ region or portion thereof. In some embodiments, the Cα region or portion thereof comprises the amino acid sequence set forth in any of SEQ ID NO: 213, 217, 218, or 524, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region contains the amino acid sequence set forth in SEQ ID NO: 214, 216, 631, or 889, or a sequence of amino acids that has at least 90% sequence identity thereto, such as a sequence having at least at or about 90, 91, 92, 93, 94, 95, 96, 97, 98, or 99% identity with such a sequence. In some embodiments, the Cα and/or Cβ regions are modified, for example, by incorporation of one or more non-native cysteine residues, such as any described herein. In some embodiments, the Cα region or portion thereof contains a non-native cysteine at residue 48 and comprises the amino acid sequence set forth in any of SEQ ID NOs: 196, 200, 201, 203, or 525, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue (e.g., Cys48). In some aspects, the Cβ region contains a non-native cysteine at residue 57 and contains the amino acid sequence set forth in SEQ ID NO: 197, 199, 890, or 1363, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 48, 58, 283, 687, 705, 722, 737, 755, 771, 783, 795, 811, 826, 841, 853, 865, 877, 891, 904, 921, 933, 947, 959, 971, 983, 995, or 1386, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 52, 285, 62, 696, 714, 731, 746, 764, 777, 789, 804, 820, 835, 847, 859, 871, 883, 897, 913, 927, 941, 953, 965, 977, 989, 1004, or 1376, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 49, 59, 284, 688, 706, 723, 738, 756, 772, 784, 796, 812, 827, 842, 854, 866, 878, 892, 905, 922, 934, 948, 960, 972, 984, 996, or 1387, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 53, 63, 286, 697, 715, 732, 747, 765, 778, 790, 805, 821, 836, 848, 860, 872, 884, 898, 914, 928, 942, 954, 966, 978, 990, 1005, or 1377, or a sequence of amino acids that has at least 90% sequence identity thereto, such as a sequence having at least at or about 90, 91, 92, 93, 94, 95, 96, 97, 98, or 99% identity with such a sequence.

In some embodiments, the Vα and Vβ regions contain the amino acid sequences corresponding to the SEQ ID NOs. set forth in Table 6 or Table 7. In some aspects, the TCR contains constant alpha and constant beta region sequences, such as those corresponding to the SEQ ID NOs. set forth in Table 6 or Table 7. In some cases, the TCR contains a full sequence comprising the variable and constant chain, such as a sequence corresponding to the SEQ ID NOs. set forth in Table 6 or Table 7 ("Full"). In some embodiments, the full sequence containing the variable and constant regions also includes a signal sequence and thus comprises a sequence corresponding to the SEQ ID NOs. set forth in Table 6 or Table 7 ("Full+signal"). Also among the provided TCRs are those containing sequences at least at or about 90, 91, 92, 93, 94, 95, 96, 97, 98, or 99% identical to such sequences. Exemplary TCRs containing such sequences, or their modified versions as described elsewhere herein, also are set forth in the Tables 6 and 7, respectively.

TABLE 6

HPV16 E7(11-19) TCR Native SEQ ID NOs.

| Exemplary TCR | Alpha | | | | Beta | | | |
|---|---|---|---|---|---|---|---|---|
| | Variable (Vα) | Constant | Full | Full + signal | Variable (Vβ) | Constant | Full | Full + signal |
| TCR 6 | 117 | 217 | 48 | 330 | 118, 296 | 216 | 52, 285 | 332, 246 |
| TCR 7 | 119 | 218 | 58 | 334 | 120 | 214 | 62 | 336 |
| TCR 12 | 295 | 213 | 283 | 222 | 118, 296 | 216 | 52, 285 | 332, 246 |
| TCR 31 | 691 | 213 | 687 | 689 | 700 | 216 | 696 | 698 |
| TCR 32 | 709 | 213 | 705 | 707 | 718 | 216 | 714 | 716 |

TABLE 6-continued

HPV16 E7(11-19) TCR Native SEQ ID NOs.

| Exemplary TCR | Alpha | | | | Beta | | | |
|---|---|---|---|---|---|---|---|---|
| | Variable (Vα) | Constant | Full | Full + signal | Variable (Vβ) | Constant | Full | Full + signal |
| TCR 33 | 726 | 213 | 722 | 724 | 735 | 216 | 731 | 733 |
| TCR 34 | 741 | 213 | 737 | 739 | 750 | 216 | 746 | 748 |
| TCR 35 | 759 | 213 | 755 | 757 | 768 | 216 | 764 | 766 |
| TCR 36 | 775 | 218 | 771 | 773 | 781 | 216 | 777 | 779 |
| TCR 37 | 787 | 213 | 783 | 785 | 793 | 214 | 789 | 791 |
| TCR 38 | 799 | 213 | 795 | 797 | 808 | 216 | 804 | 806 |
| TCR 39 | 815 | 213 | 811 | 813 | 824 | 214 | 820 | 822 |
| TCR 40 | 830 | 213 | 826 | 828 | 839 | 216 | 835 | 837 |
| TCR 41 | 845 | 213 | 841 | 843 | 851 | 216 | 847 | 849 |
| TCR 42 | 857 | 213 | 853 | 855 | 863 | 216 | 859 | 861 |
| TCR 43 | 869 | 213 | 865 | 867 | 875 | 216 | 871 | 873 |
| TCR 44 | 881 | 213 | 877 | 879 | 887 | 889 | 883 | 885 |
| TCR 45 | 895 | 213 | 891 | 893 | 901 | 216 | 897 | 899 |
| TCR 46 | 908 | 213 | 904 | 906 | 917 | 216 | 913 | 915 |
| TCR 47 | 925 | 524 | 921 | 923 | 931 | 216 | 927 | 929 |
| TCR 48 | 937 | 213 | 933 | 935 | 945 | 216 | 941 | 943 |
| TCR 49 | 951 | 213 | 947 | 949 | 957 | 216 | 953 | 955 |
| TCR 50 | 963 | 213 | 959 | 961 | 969 | 214 | 965 | 967 |
| TCR 51 | 975 | 213 | 971 | 973 | 981 | 214 | 977 | 979 |
| TCR 52 | 987 | 213 | 983 | 985 | 993 | 214 | 989 | 991 |
| TCR 53 | 999 | 213 | 995 | 997 | 1008 | 216 | 1004 | 1006 |
| TCR 54 | 119 | 218 | 58 | 334 | 120 | 214 | 62 | 336 |
| TCR 55 | 295 | 213 | 283 | 222 | 118, 296 | 216 | 52, 285 | 332, 246 |
| TCR 66 | 1390 | 218 | 1386 | 1388 | 1380 | 216 | 1376 | 1378 |

TABLE 7

HPV16 E7(11-19) TCR Modified SEQ ID NOs.

| Exemplary modified version of TCR | Alpha | | | | Beta | | | |
|---|---|---|---|---|---|---|---|---|
| | Variable (Vα) | Constant | Full | Full + signal | Variable (Vβ) | Constant | Full | Full + signal |
| TCR 6 | 117 | 200 | 49 | 331 | 118, 296 | 199 | 53, 286 | 333, 250 |
| TCR 7 | 119 | 201 | 59 | 335 | 120 | 197 | 63 | 337 |
| TCR 12 | 295 | 196 | 284 | 242 | 118, 296 | 199 | 53, 286 | 333, 250 |
| TCR 31 | 691 | 203 | 688 | 690 | 700 | 199 | 697 | 699 |
| TCR 32 | 709 | 203 | 706 | 708 | 718 | 199 | 715 | 717 |
| TCR 33 | 726 | 203 | 723 | 725 | 735 | 199 | 732 | 734 |
| TCR 34 | 741 | 203 | 738 | 740 | 750 | 199 | 747 | 749 |
| TCR 35 | 759 | 203 | 756 | 758 | 768 | 199 | 765 | 767 |
| TCR 36 | 775 | 201 | 772 | 774 | 781 | 199 | 778 | 780 |
| TCR 37 | 787 | 203 | 784 | 786 | 793 | 197 | 790 | 792 |
| TCR 38 | 799 | 203 | 796 | 798 | 808 | 199 | 805 | 807 |
| TCR 39 | 815 | 203 | 812 | 814 | 824 | 197 | 821 | 823 |
| TCR 40 | 830 | 203 | 827 | 829 | 839 | 199 | 836 | 838 |
| TCR 41 | 845 | 203 | 842 | 844 | 851 | 199 | 848 | 850 |
| TCR 42 | 857 | 203 | 854 | 856 | 863 | 199 | 860 | 862 |
| TCR 43 | 869 | 203 | 866 | 868 | 875 | 199 | 872 | 874 |
| TCR 44 | 881 | 203 | 878 | 880 | 887 | 890 | 884 | 886 |
| TCR 45 | 895 | 203 | 892 | 894 | 901 | 199 | 898 | 900 |
| TCR 46 | 908 | 203 | 905 | 907 | 917 | 199 | 914 | 916 |
| TCR 47 | 925 | 525 | 922 | 924 | 931 | 199 | 928 | 930 |
| TCR 48 | 937 | 203 | 934 | 936 | 945 | 199 | 942 | 944 |
| TCR 49 | 951 | 203 | 948 | 950 | 957 | 199 | 954 | 956 |
| TCR 50 | 963 | 203 | 960 | 962 | 969 | 197 | 966 | 968 |
| TCR 51 | 975 | 203 | 972 | 974 | 981 | 199 | 978 | 980 |
| TCR 52 | 987 | 203 | 984 | 986 | 993 | 199 | 990 | 992 |
| TCR 53 | 999 | 203 | 996 | 998 | 1008 | 199 | 1005 | 1007 |
| TCR 54 | 119 | 201 | 59 | 335 | 120 | 197 | 63 | 337 |
| TCR 55 | 295 | 196 | 284 | 242 | 118, 296 | 199 | 53, 286 | 333, 250 |
| TCR 66 | 1390 | 201 | 1387 | 1389 | 1380 | 199 | 1377 | 1379 | c. HPV 16 E7(86-93)

In some cases, the TCR recognizes or binds a peptide epitope derived from HPV16 E7 that is or contains E7(86-93) TLGIVCPI (SEQ ID NO: 235). In some embodiments, the TCR recognizes or binds HPV 16 E7(86-93) in the context of an MHC, such as an MHC class I, e.g. HLA-A2.

In some embodiments, the Vα region contains a complementarity determining region 3 (CDR-3) comprising the amino acid sequence set forth in SEQ ID NO: 175. In some embodiments, the Vα region contains a CDR3 sequence at least at or about 90, 91, 92, 93, 94, 95, 96, 97, 98, or 99% identical to such sequences. In some aspects, the Vα region contains a complementarity determining region 1 (CDR-1) comprising the amino acid sequence set forth in SEQ ID NO: 142, or a sequence having at least at or about 90, 91, 92, 93, 94, 95, 96, 97, 98, or 99% identity with such a sequence. In some aspects, the Vα region comprises a complementarity determining region 2 (CDR-2) comprising the amino acid sequence set forth in SEQ ID NO: 143, or a sequence having at least at or about 90, 91, 92, 93, 94, 95, 96, 97, 98, or 99% identity with such a sequence.

In some embodiments, the Vβ region contains a complementarity determining region 3 (CDR-3) comprising the amino acid sequence set forth in SEQ ID NO: 178, or a sequence having at least at or about 90, 91, 92, 93, 94, 95, 96, 97, 98, or 99% identity with such a sequence. In some cases, the Vβ region contains a complementarity determining region 1 (CDR-1) comprising an amino acid sequence set forth in SEQ ID NO:176, or a sequence having at least at or about 90, 91, 92, 93, 94, 95, 96, 97, 98, or 99% identity with such a sequence. In some aspects, the Vβ region contains a complementarity determining region 2 (CDR-2) comprising an amino acid sequence set forth in SEQ ID NO: 177, or a sequence having at least at or about 90, 91, 92, 93, 94, 95, 96, 97, 98, or 99% identity with such a sequence.

In some embodiments, the Vα region contains a CDR-1, CDR-2, and CDR-3, comprising the amino acid sequences of SEQ ID NOs: 142, 143, and 175, respectively. In some such embodiments, the Vβ region contains a CDR-1, CDR-2, and CDR-3, comprising the amino acid sequences of SEQ ID NOs: 176, 177, and 178, respectively. Also among the provided TCRs are those having sequences at least at or about 90, 91, 92, 93, 94, 95, 96, 97, 98, or 99% identical to such sequences.

In some aspects, the Vα region contains a complementarity determining region 1 (CDR-1), a CDR-2, and a CDR-3, respectively comprising the CDR-1, CDR-2, and CDR-3 amino acid sequences contained within a Vα region amino acid sequence set forth in SEQ ID NO: 127. In some embodiments, the Vβ region contains a CDR-1, a CDR-2, and a CDR-3, respectively comprising the CDR-1, CDR-2, and CDR-3 amino acid sequences contained within a Vβ region amino acid sequence set forth in SEQ ID NO: 128. Also among the provided TCRs are those containing sequences at least at or about 90, 91, 92, 93, 94, 95, 96, 97, 98, or 99% identical to such sequences.

In some embodiments, the TCR or antigen-binding fragment includes a Vα region contains a complementarity determining region 1 (CDR-1), a CDR-2, and a CDR-3, respectively comprising the CDR-1, CDR-2, and CDR-3 amino acid sequences set forth in Table 8, and a Vβ region that contains a complementarity determining region 1 (CDR-1), a CDR-2, and a CDR-3, respectively comprising the CDR-1, CDR-2, and CDR-3 amino acid sequences set forth in Table 8. Also among the provided TCRs are those containing sequences at least at or about 90, 91, 92, 93, 94, 95, 96, 97, 98, or 99% identical to such sequences. Exemplary TCRs containing such CDRs, or their modified versions as described elsewhere herein, also are set forth in the Table 8.

TABLE 8

| HPV16 E7(86-93) TCR CDR SEQ ID NOs. | | | | | | |
|---|---|---|---|---|---|---|
| Exemplary | Alpha | | | Beta | | |
| TCR | CDR1 | CDR2 | CDR3 | CDR1 | CDR2 | CDR3 |
| TCR 11 | 142 | 143 | 175 | 176 | 177 | 178 |

In some embodiments, the TCR or antigen-binding fragment thereof contains Vα and Vβ regions comprise the amino acid sequences of SEQ ID NOs: 127 and 128, respectively. Also among the provided TCRs are those containing sequences at least at or about 90, 91, 92, 93, 94, 95, 96, 97, 98, or 99% identical to such sequences.

In some embodiments, the alpha chain of the TCR or antigen-binding fragment thereof further contains a Cα region or portion thereof and/or the beta chain further contains a Cβ region or portion thereof. In some embodiments, the Cα region or portion thereof comprises the amino acid sequence set forth in any of SEQ ID NO: 212, 213 or 217, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region contains the amino acid sequence set forth in SEQ ID NO: 214, or 216, or a sequence of amino acids that has at least 90% sequence identity thereto, such as a sequence having at least at or about 90, 91, 92, 93, 94, 95, 96, 97, 98, or 99% identity with such a sequence. In some embodiments, the Cα and/or Cβ regions are modified, for example, by incorporation of one or more non-native cysteine residues, such as any described herein. In some embodiments, the Cα region or portion thereof contains a non-native cysteine at residue 48 and comprises the amino acid sequence set forth in SEQ ID NO: 200, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue (e.g. Cys48). In some aspects, the Cβ region contains a non-native cysteine at residue 57 and contains the amino acid sequence set forth in SEQ ID NO: 197 or 199, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 98 or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 102 or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 99 or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 103 or a sequence of amino acids that has at least 90% sequence identity thereto, such as a sequence having at least at or about 90, 91, 92, 93, 94, 95, 96, 97, 98, or 99% identity with such a sequence.

In some embodiments, the Vα and Vβ regions contain the amino acid sequences corresponding to the SEQ ID NOs. set forth in Table 9 or Table 10. In some aspects, the TCR contains constant alpha and constant beta region sequences, such as those corresponding to the SEQ ID NOs. set forth in Table 9 or Table 10. In some cases, the TCR contains a full sequence comprising the variable and constant chain, such as a sequence corresponding to the SEQ ID NOs. set forth in Table 9 or Table 10 ("Full"). In some embodiments, the full sequence containing the variable and constant regions also includes a signal sequence and thus comprises a sequence corresponding to the SEQ ID NOs. set forth in Table 9 or Table 10 ("Full+signal"). Also among the provided TCRs are those containing sequences at least at or about 90, 91, 92, 93, 94, 95, 96, 97, 98, or 99% identical to such sequences. Exemplary TCRs containing such sequences, or their modified versions as described elsewhere herein, also are set forth in the Tables 9 and 10, respectively.

TABLE 9

HPV16 E7(86-93) TCR Native SEQ ID NOs.

| Exemplary TCR | Alpha | | | | Beta | | | |
|---|---|---|---|---|---|---|---|---|
| | Variable (Vα) | Constant | Full | Full + signal | Variable (Vβ) | Constant | Full | Full + signal |
| TCR 11 | 127 | 217 | 98 | 195 | 128 | 216 | 102 | 352 |

TABLE 10

HPV16 E7(86-93) TCR Modified SEQ ID NOs.

| Exemplary modified version of TCR | Alpha | | | | Beta | | | |
|---|---|---|---|---|---|---|---|---|
| | Variable (Vα) | Constant | Full | Full + signal | Variable (Vβ) | Constant | Full | Full + signal |
| TCR 11 | 127 | 200 | 99 | 205 | 128 | 199 | 103 | 221 |

2. Variants & Modifications

In some embodiments, the binding molecule, e.g., TCR or antigen-binding fragment thereof, is or has been modified. In certain embodiments, the binding molecules, e.g., TCRs or antigen-binding fragments thereof, include one or more amino acid variations, e.g., substitutions, deletions, insertions, and/or mutations, compared to the sequence of a binding molecule, e.g., TCR, described herein. Exemplary variants include those designed to improve the binding affinity and/or other biological properties of the binding molecule Amino acid sequence variants of a binding molecule may be prepared by introducing appropriate modifications into the nucleotide sequence encoding the binding molecule, or by peptide synthesis. Such modifications include, for example, deletions from, and/or insertions into and/or substitutions of residues within the amino acid sequences of the binding molecule. Any combination of deletion, insertion, and substitution can be made to arrive at the final construct, provided that the final construct possesses the desired characteristics, e.g., antigen-binding.

In some embodiments, directed evolution methods are used to generate TCRs with altered properties, such as with higher affinity for a specific peptide in the context of an MHC molecule. In some embodiments, directed evolution is achieved by display methods including, but not limited to, yeast display (Holler et al. (2003) Nat Immunol, 4, 55-62; Holler et al. (2000) Proc Natl Acad Sci USA, 97, 5387-92), phage display (Li et al. (2005) Nat Biotechnol, 23, 349-54), or T cell display (Chervin et al. (2008) J Immunol Methods, 339, 175-84). In some embodiments, display approaches involve engineering, or modifying, a known, parent or reference TCR. For example, in some cases, a reference TCR, such as any provided herein, can be used as a template for producing mutagenized TCRs in which in one or more residues of the CDRs are mutated, and mutants with a desired altered property, such as higher affinity for peptide epitope in the context of an MHC molecule, are selected.

In certain embodiments, the binding molecules, e.g., TCRs or antigen-binding fragments thereof, include one or more amino acid substitutions, e.g., as compared to a binding molecule, e.g., TCR, sequence described herein and/or compared to a sequence of a natural repertoire, e.g., human repertoire. Sites of interest for substitutional mutagenesis include the CDRs, FRs and/or constant regions Amino acid substitutions may be introduced into a binding molecule of interest and the products screened for a desired activity, e.g., retained/improved antigen affinity or avidity, decreased immunogenicity, improved half-life, CD8-independent binding or activity, surface expression, promotion of TCR chain pairing and/or other improved properties or functions.

In some embodiments, one or more residues within a CDR of a parent binding molecule, e.g., TCR, is/are substituted. In some embodiments, the substitution is made to revert a sequence or position in the sequence to a germline sequence, such as a binding molecule sequence found in the germline (e.g., human germline), for example, to reduce the likelihood of immunogenicity, e.g., upon administration to a human subject.

In certain embodiments, substitutions, insertions, or deletions may occur within one or more CDRs so long as such alterations do not substantially reduce the ability of the binding molecule, e.g., TCR or antigen-binding fragment thereof, to bind antigen. For example, conservative alterations (e.g., conservative substitutions as provided herein) that do not substantially reduce binding affinity may be made in CDRs. Such alterations may, for example, be outside of antigen contacting residues in the CDRs. In certain embodiments of the variable sequences provided herein, each CDR either is unaltered, or contains no more than one, two or three amino acid substitutions.

Amino acid sequence insertions include amino- and/or carboxyl-terminal fusions ranging in length from one residue to polypeptides containing a hundred or more residues, as well as intrasequence insertions of single or multiple amino acid residues.

In some aspects, the TCR or antigen-binding fragment thereof may contain one or more modifications in the alpha chain and/or beta chain such that when the TCR or antigen-binding fragment thereof is expressed in a cell, the frequency of mis-pairing between the TCR alpha chain and beta chain and an endogenous TCR alpha chain and beta chain is reduced, the expression of the TCR alpha chain and beta chain is increased, and/or the stability of the TCR alpha chain and beta chain is increased.

In some embodiments, the TCR contains one or more non-native cysteine residues to introduce a covalent disulfide bond linking a residue of the immunoglobulin region of the constant domain of the α chain to a residue of the immunoglobulin region of the constant domain of the β chain. In some embodiments, one or more cysteines can be incorporated into the constant region extracellular sequences of the first and second segments of the TCR polypeptide. Exemplary non-limiting modifications in a TCR to introduce a non-native cysteine residues are described herein (see also, International PCT No. WO2006/000830 and WO2006037960). In some cases, both a native and a non-native disulfide bond may be desirable. In some embodiments, the TCR or antigen-binding fragment is modified such that the interchain disulfide bond in a native TCR is not present.

In some embodiments, the transmembrane domain of the constant region of the TCR can be modified to contain a greater number of hydrophobic residues (see e.g. Haga-Friedman et al. (2012) Journal of Immunology, 188:5538-5546). In some embodiments, the transmembrane region of TCR α chain contains one or more mutations corresponding to S116L, G119V or F120L, with reference to numbering of a Cα set forth in any of SEQ ID NOS: 212, 213, 215, 217, 220, or 524.

In some embodiments, the cell expressing the TCR further includes a marker, such as a cell surface marker, which may be used to confirm transduction or engineering of the cell to express the TCR, such as a truncated version of a cell surface receptor, such as truncated EGFR (tEGFR). Exemplary surrogate markers can include truncated forms of cell surface polypeptides, such as truncated forms that are non-functional and to not transduce or are not capable of transducing a signal or a signal ordinarily transduced by the full-length form of the cell surface polypeptide, and/or do not or are not capable of internalizing Exemplary truncated cell surface polypeptides including truncated forms of growth factors or other receptors such as a truncated human epidermal growth factor receptor 2 (tHER2), a truncated epidermal growth factor receptor (tEGFR, exemplary tEGFR sequence set forth in SEQ ID NO: 273 or 343) or a prostate-specific membrane antigen (PSMA) or modified form thereof. tEGFR may contain an epitope recognized by the antibody cetuximab (Erbitux®) or other therapeutic anti-EGFR antibody or binding molecule, which can be used to identify or select cells that have been engineered with the tEGFR construct and an encoded exogenous protein, and/or to eliminate or separate cells expressing the encoded exogenous protein. See U.S. Pat. No. 8,802,374 and Liu et al., Nature Biotech. 2016 April; 34(4): 430-434). In some aspects, the marker, e.g. surrogate marker, includes all or part (e.g., truncated form) of CD34, a NGFR, a CD19 or a truncated CD19, e.g., a truncated non-human CD19, or epidermal growth factor receptor (e.g., tEGFR). In some embodiments, the marker is or comprises a fluorescent protein, such as green fluorescent protein (GFP), enhanced green fluorescent protein (EGFP), such as super-fold GFP (sfGFP), red fluorescent protein (RFP), such as tdTomato, mCherry, mStrawberry, AsRed2, DsRed or DsRed2, cyan fluorescent protein (CFP), blue green fluorescent protein (BFP), enhanced blue fluorescent protein (EBFP), and yellow fluorescent protein (YFP), and variants thereof, including species variants, monomeric variants, and codon-optimized and/or enhanced variants of the fluorescent proteins. In some embodiments, the marker is or comprises an enzyme, such as a luciferase, the lacZ gene from *E. coli*, alkaline phosphatase, secreted embryonic alkaline phosphatase (SEAP), chloramphenicol acetyl transferase (CAT). Exemplary light-emitting reporter genes include luciferase (luc), β-galactosidase, chloramphenicol acetyltransferase (CAT), β-glucuronidase (GUS) or variants thereof.

In some embodiments, the marker is a selection marker. In some embodiments, the selection marker is or comprises a polypeptide that confers resistance to exogenous agents or drugs. In some embodiments, the selection marker is an antibiotic resistance gene. In some embodiments, the selection marker is an antibiotic resistance gene confers antibiotic resistance to a mammalian cell. In some embodiments, the selection marker is or comprises a Puromycin resistance gene, a Hygromycin resistance gene, a Blasticidin resistance gene, a Neomycin resistance gene, a Geneticin resistance gene or a Zeocin resistance gene or a modified form thereof.

In some aspects, the marker includes all or part (e.g., truncated form) of CD34, a NGFR, or epidermal growth factor receptor (e.g., tEGFR). In some embodiments, the nucleic acid encoding the marker is operably linked to a polynucleotide encoding for a linker sequence, such as a cleavable linker sequence, e.g., T2A. See WO2014031687. In some embodiments, introduction of a construct encoding the TCR and EGFRt separated by a T2A, P2A or other ribosome switch can express two proteins from the same construct, such that the EGFRt can be used as a marker to detect cells expressing such construct. Exemplary of such markers that can be used are described below.

In some embodiments, the TCR or antigen-binding fragment thereof is encoded by a nucleotide sequence that is or has been codon-optimized. Exemplary codon-optimized variants are described elsewhere herein.

B. Antibodies

In some embodiments, the binding molecule is an antibody or antigen-binding fragment thereof that contains any one or more of the CDRs as described above with respect to TCRs.

In some embodiments, the antibody or antigen-binding fragment contains variable heavy and light chain containing a CDR1, CDR2 and/or CDR3 contained in the alpha chain and a CDR1, CDR2 and/or CDR3 contained in the beta chain as set forth in Table 2, Table 5, or Table 8. Also among the provided antibodies or antigen-binding fragments are those containing sequences at least at or about 90, 91, 92, 93, 94, 95, 96, 97, 98, or 99% identical to such sequences.

In some embodiments, the antibody or antigen-binding fragment contains a variable region that contains a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676. In some aspects, the antibody or antigen-binding fragment contains a variable region that contains a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 112, 114, 116, 122, 124 126, 298, 300, 483, 498, 516, 530, 545, 560, 578, 593, 605, 617, 629, 643, 655, 667, or 685. Also among the provided antibodies or antigen-bind fragments are those containing sequences at least at or about 90, 91, 92, 93, 94, 95, 96, 97, 98, or 99% identical to such sequences.

In some embodiments, the provided antibody or antibody fragment is a human antibody. In some embodiments, the provided antibody or antibody fragment contains a $V_H$ region that contains a portion having at least 95%, 96%, 97%, 98%, 99%, or 100% sequence identity to an amino acid sequence encoded by a germline nucleotide human heavy chain V segment, a portion with at least 95%, 96%, 97%, 98%, 99%, or 100% identity to an amino acid sequence encoded by a germline nucleotide human heavy chain D segment, and/or a portion having at least 95%, 96%, 97%, 98%, 99%, or 100% identity to an amino acid sequence encoded by a germline nucleotide human heavy chain J segment; and/or contains a $V_L$ region that contains a portion with at least 95%, 96%, 97%, 98%, 99%, or 100% identity to an amino acid sequence encoded by a germline nucleotide human kappa or lambda chain V segment, and/or a portion with at least 95%, 96%, 97%, 98%, 99%, or 100% identity to an amino acid sequence encoded by a germline nucleotide human kappa or lambda chain J segment. In some embodiments, the portion of the $V_H$ region corresponds to the CDR-H1, CDR-H2 and/or CDR-H3. In some embodiments, the portion of the $V_H$ region corresponds to the framework region 1 (FR1), FR2, FR2 and/or FR4. In some embodiments, the portion of the $V_L$ region corresponds to the CDR-L1, CDR-L2 and/or CDR-L3. In some embodiments, the portion of the $V_L$ region corresponds to the FR1, FR2, FR2 and/or FR4.

In some embodiments, the antibody or antigen-binding fragment contains a framework region that contains human germline gene segment sequences. For example, in some embodiments, the antibody or antigen-binding fragment contains a $V_H$ region in which the framework region, e.g. FR1, FR2, FR3 and FR4, has at least 95%, 96%, 97%, 98%, 99%, or 100% sequence identity to a framework region encoded by a human germline antibody segment, such as a V and/or J segment. In some embodiments, the human antibody contains a $V_L$ region in which the framework region e.g. FR1, FR2, FR3 and FR4, has at least 95%, 96%, 97%, 98%, 99%, or 100% sequence identity to a framework region encoded by a human germline antibody segment, such as a V and/or segment. For example, in some such embodiments, the framework sequence of the $V_H$ and/or $V_L$ sequence differs by no more than 10 amino acids, such as no more than 9, 8, 7, 6, 5, 4, 3, 2 or 1 amino acid, compared to the framework region encoded by a human germline antibody segment. In some embodiments, the antibodies and antigen binding fragments thereof, e.g. TCR-like antibodies, specifically recognize a peptide epitope in the context of an MHC molecule, such as an MHC class I. In some cases, the MHC class I molecule is an HLA-A2 molecule, e.g. HLA-A2*01.

In some embodiments, the antibody or antigen-binding fragment thereof recognizes or binds to an epitope or region of HPV16 E6, such as a peptide epitope containing an amino acid sequence set forth in any of SEQ ID NOs: 232-234. In some instances, the TCR or antigen-binding fragment thereof that recognizes or binds a peptide epitope derived from HPV16 E6 is or comprises the sequence set forth in SEQ ID NO: 233.

In some aspects, the TCR or antigen-binding fragment recognizes or binds to an epitope or region of HPV16 E7 protein, such as a peptide epitope containing an amino acid sequence set forth in any of SEQ ID NOs: 235-239. In some embodiments, the TCR or antigen-binding fragment thereof does not recognize or bind the epitope E7 (11-19) comprising the amino acid sequence YMLDLQPET (SEQ ID NO. 236). In some cases, the peptide derived from HPV16 E7 is or contains the sequence set forth in SEQ ID NO: 235.

Thus, provided in some embodiments are anti-HPV antibodies, including functional antibody fragments. In some embodiments, the antibodies $V_H$ and/or $V_L$ domains, or antigen-binding site thereof, and are capable of specifically binding to a peptide epitope of HPV 16. In some embodiments, the antibodies include a variable heavy chain and a variable light chain, such as scFvs. The antibodies include antibodies that specifically bind to HPV, e.g., HPV 16 E6 or HPV 16 E7. Among the provided anti-HPV antibodies are human antibodies. The antibodies include isolated antibodies. Also provided are molecules containing such antibodies, e.g., single-chain proteins, fusion proteins, and/or recombinant receptors such as chimeric receptors, including antigen receptors.

The term "antibody" herein is used in the broadest sense and includes polyclonal and monoclonal antibodies, including intact antibodies and functional (antigen-binding) antibody fragments, including fragment antigen binding (Fab) fragments, F(ab')₂ fragments, Fab' fragments, Fv fragments, recombinant IgG (rIgG) fragments, variable heavy chain ($V_H$) regions capable of specifically binding the antigen, single chain antibody fragments, including single chain variable fragments (scFv), and single domain antibodies (e.g., sdAb, sdFv, nanobody) fragments. The term encompasses genetically engineered and/or otherwise modified forms of immunoglobulins, such as intrabodies, peptibodies, chimeric antibodies, fully human antibodies, humanized antibodies, and heteroconjugate antibodies, multispecific, e.g., bispecific, antibodies, diabodies, triabodies, and tetrabodies, tandem di-scFv, tandem tri-scFv. Unless otherwise stated, the term "antibody" should be understood to encompass functional antibody fragments thereof. The term also encompasses intact or full-length antibodies, including antibodies of any class or sub-class, including IgG and sub-classes thereof, IgM, IgE, IgA, and IgD.

In some embodiments, the heavy and light chains of an antibody can be full-length or can be an antigen-binding portion (a Fab, F(ab')2, Fv or a single chain Fv fragment (scFv)). In other embodiments, the antibody heavy chain constant region is chosen from, e.g., IgG1, IgG2, IgG3, IgG4, IgM, IgA1, IgA2, IgD, and IgE, particularly chosen from, e.g., IgG1, IgG2, IgG3, and IgG4, more particularly, IgG1 (e.g., human IgG1). In another embodiment, the antibody light chain constant region is chosen from, e.g., kappa or lambda, particularly kappa.

Among the provided antibodies are antibody fragments. An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')2; diabodies; linear antibodies; variable heavy chain ($V_H$) regions, single-chain antibody molecules such as scFvs and single-domain $V_H$ single antibodies; and multispecific antibodies formed from antibody fragments. In particular embodiments, the antibodies are single-chain antibody fragments comprising a variable heavy chain region and/or a variable light chain region, such as scFvs.

The term "variable region" or "variable domain", when used in reference to an antibody, such as an antibody fragment, refers to the domain of an antibody heavy or light chain that is involved in binding the antibody to antigen. The variable domains of the heavy chain and light chain ($V_H$ and $V_L$, respectively) of a native antibody generally have similar structures, with each domain comprising four conserved framework regions (FRs) and three CDRs. (See, e.g., Kindt et al. Kuby Immunology, 6th ed., W.H. Freeman and Co., page 91 (2007). A single $V_H$ or $V_L$ domain may be sufficient to confer antigen-binding specificity. Furthermore, antibodies that bind a particular antigen may be isolated using a $V_H$ or $V_L$ domain from an antibody that binds the antigen to screen a library of complementary $V_L$ or $V_H$ domains, respectively. See, e.g., Portolano et al., J. Immunol. 150: 880-887 (1993); Clarkson et al., Nature 352:624-628 (1991).

Single-domain antibodies are antibody fragments comprising all or a portion of the heavy chain variable domain or all or a portion of the light chain variable domain of an antibody. In certain embodiments, a single-domain antibody is a human single-domain antibody.

Antibody fragments can be made by various techniques, including but not limited to proteolytic digestion of an intact antibody as well as production by recombinant host cells. In some embodiments, the antibodies are recombinantly-produced fragments, such as fragments comprising arrangements that do not occur naturally, such as those with two or more antibody regions or chains joined by synthetic linkers, e.g., peptide linkers, and/or that are may not be produced by enzyme digestion of a naturally-occurring intact antibody. In some aspects, the antibody fragments are scFvs.

Among the provided anti-HPV antibodies are human antibodies. A "human antibody" is an antibody with an amino acid sequence corresponding to that of an antibody produced by a human or a human cell, or non-human source that utilizes human antibody repertoires or other human antibody-encoding sequences, including human antibody libraries. The term excludes humanized forms of non-human antibodies comprising non-human antigen-binding regions, such as those in which all or substantially all CDRs are non-human. The term includes antigen-binding fragments of human antibodies.

A "humanized" antibody is an antibody in which all or substantially all CDR amino acid residues are derived from non-human CDRs and all or substantially all FR amino acid residues are derived from human FRs. A humanized antibody optionally may include at least a portion of an antibody constant region derived from a human antibody. A "humanized form" of a non-human antibody, refers to a variant of the non-human antibody that has undergone humanization, typically to reduce immunogenicity to humans, while retaining the specificity and affinity of the parental non-human antibody. In some embodiments, some FR residues in a humanized antibody are substituted with corresponding residues from a non-human antibody (e.g., the antibody from which the CDR residues are derived), e.g., to restore or improve antibody specificity or affinity.

Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic animals, the endogenous immunoglobulin loci have generally been inactivated. Human antibodies also may be derived from human antibody libraries, including phage display and cell-free libraries, containing antibody-encoding sequences derived from a human repertoire.

Among the provided antibodies are monoclonal antibodies, including monoclonal antibody fragments. The term "monoclonal antibody" as used herein refers to an antibody obtained from or within a population of substantially homogeneous antibodies, i.e., the individual antibodies comprising the population are identical, except for possible variants containing naturally occurring mutations or arising during production of a monoclonal antibody preparation, such variants generally being present in minor amounts. In contrast to polyclonal antibody preparations, which typically include different antibodies directed against different epitopes, each monoclonal antibody of a monoclonal antibody preparation is directed against a single epitope on an antigen. The term is not to be construed as requiring production of the antibody by any particular method. A monoclonal antibody may be made by a variety of techniques, including but not limited to generation from a hybridoma, recombinant DNA methods, phage-display and other antibody display methods.

As used herein, reference to a "corresponding form" of an antibody means that when comparing a property or activity of two antibodies, the property is compared using the same form of the antibody. For example, if it is stated that an antibody has greater activity compared to the activity of the corresponding form of a first antibody, that means that a particular form, such as a scFv of that antibody, has greater activity compared to the scFv form of the first antibody.

"Effector functions" refer to those biological activities attributable to the Fc region of an antibody, which vary with the antibody isotype. Examples of antibody effector functions include: C1q binding and complement dependent cytotoxicity (CDC); Fc receptor binding; antibody-dependent cell-mediated cytotoxicity (ADCC); phagocytosis; down regulation of cell surface receptors (e.g. B cell receptor); and B cell activation.

In some embodiments, the antibody, e.g., antibody fragment, may contain at least a portion of an immunoglobulin constant region, such as one or more constant region domain. In some embodiments, the constant regions include a light chain constant region and/or a heavy chain constant region 1 (CH1). In some embodiments, the antibody includes a CH2 and/or CH3 domain, such as an Fc region. In some embodiments, the Fc region is an Fc region of a human IgG, such as an IgG1 or IgG4.

The term "Fc region" herein is used to define a C-terminal region of an immunoglobulin heavy chain that contains at least a portion of the constant region. The term includes native sequence Fc regions and variant Fc regions. In one embodiment, a human IgG heavy chain Fc region extends from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

The terms "full length antibody," "intact antibody," and "whole antibody" are used herein interchangeably to refer to an antibody having a structure substantially similar to a native antibody structure or having heavy chains that contain an Fc region as defined herein.

An "isolated" antibody is one which has been separated from a component of its natural environment. In some embodiments, an antibody is purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC). For review of methods for assessment of antibody purity, see, e.g., Flatman et al., J. Chromatogr. B 848:79-87 (2007).

1. Variants and Modifications

In certain embodiments, the antibodies or antigen-binding fragments thereof include one or more amino acid variations, e.g., substitutions, deletions, insertions, and/or mutations, compared to the sequence of an antibody described herein. Exemplary variants include those designed to improve the binding affinity and/or other biological properties of the antibody. Amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding.

In certain embodiments, the antibodies include one or more amino acid substitutions, e.g., as compared to an antibody sequence described herein and/or compared to a sequence of a natural repertoire, e.g., human repertoire. Sites of interest for substitutional mutagenesis include the CDRs and FRs Amino acid substitutions may be introduced into an antibody of interest and the products screened for a desired activity, e.g., retained/improved antigen binding, decreased immunogenicity, improved half-life, and/or improved effector function, such as the ability to promote antibody-dependent cellular cytotoxicity (ADCC) or complement-dependent cytotoxicity (CDC).

In some embodiments, one or more residues within a CDR of a parent antibody (e.g. a humanized or human antibody) is/are substituted. In some embodiments, the substitution is made to revert a sequence or position in the sequence to a germline sequence, such as an antibody sequence found in the germline (e.g., human germline), for example, to reduce the likelihood of immunogenicity, e.g., upon administration to a human subject.

In some embodiments, alterations are made in CDR "hotspots," residues encoded by codons that undergo mutation at high frequency during the somatic maturation process (see, e.g., Chowdhury, Methods Mol. Biol. 207:179-196 (2008)), and/or residues that contact antigen, with the resulting variant $V_H$ or $V_L$ being tested for binding affinity. Affinity maturation by constructing and reselecting from secondary libraries has been described, e.g., in Hoogenboom et al. in Methods in Molecular Biology 178:1-37 (O'Brien et al., ed., Human Press, Totowa, N.J., (2001)). In some embodiments of affinity maturation, diversity is introduced into the variable genes chosen for maturation by any of a variety of methods (e.g., error-prone PCR, chain shuffling, or oligonucleotide-directed mutagenesis). A secondary library may then be created and screened to identify any antibody variants with the desired affinity. Another method to introduce diversity involves CDR-directed approaches, in which several CDR residues (e.g., 4-6 residues at a time) are randomized. CDR residues involved in antigen binding may be specifically identified, e.g., using alanine scanning mutagenesis or modeling. CDR-H3 and CDR-L3 in particular are often targeted.

In certain embodiments, substitutions, insertions, or deletions may occur within one or more CDRs so long as such alterations do not substantially reduce the ability of the antibody to bind antigen. For example, conservative alterations (e.g., conservative substitutions as provided herein) that do not substantially reduce binding affinity may be made in CDRs. Such alterations may, for example, be outside of antigen contacting residues in the CDRs. In certain embodiments of the variant $V_H$ and $V_L$ sequences provided above, each CDR either is unaltered, or contains no more than one, two or three amino acid substitutions.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme or a polypeptide which increases the serum half-life of the antibody.

In certain embodiments, the antibody or antigen-binding fragment thereof is altered to increase or decrease the extent to which the antibody is glycosylated, for example, by removing or inserting one or more glycosylation sites by altering the amino acid sequence and/or by modifying the oligosaccharide(s) attached to the glycosylation sites, e.g., using certain cell lines.

Exemplary modifications, variants, and cell lines are described, e.g., in Patent Publication Nos. US 2003/0157108, US 2004/0093621, US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; WO2002/031140; Okazaki et al. J. Mol. Biol. 336:1239-1249 (2004); Yamane-Ohnuki et al. Biotech. Bioeng. 87: 614 (2004). Ripka et al. Arch. Biochem. Biophys. 249:533-545 (1986); US Pat Appl No US 2003/0157108 A1, Presta, L; and WO 2004/056312 A1, Yamane-Ohnuki et al. Biotech. Bioeng. 87: 614 (2004); Kanda, Y. et al., Biotechnol. Bioeng., 94(4):680-688 (2006); and WO2003/085107); WO 2003/011878 (Jean-Mairet et al.); U.S. Pat. No. 6,602,684 (Umana et al.); and US 2005/0123546 (Umana et al.); WO 1997/30087 (Patel et al.); WO 1998/58964 (Raju, S.); and WO 1999/22764 (Raju, S.).

Among the modified antibodies are those having one or more amino acid modifications in the Fc region, such as those having a human Fc region sequence or other portion of a constant region (e.g., a human IgG1, IgG2, IgG3 or IgG4 Fc region) comprising an amino acid modification (e.g., a substitution) at one or more amino acid positions.

Such modifications can be made, e.g., to improve half-life, alter binding to one or more types of Fc receptors, and/or alter effector functions.

Also among the variants are cysteine engineered antibodies such as "thioMAbs" and other cysteine engineered variants, in which one or more residues of an antibody are substituted with cysteine residues, in order to generate reactive thiol groups at accessible sites, e.g., for use in conjugation of agents and linker-agents, to produce immunoconjugates. Cysteine engineered antibodies are described, e.g., in U.S. Pat. Nos. 7,855,275 and 7,521,541.

In some embodiments, the antibodies are modified to contain additional nonproteinaceous moieties, including water soluble polymers. Exemplary polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone) polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer is attached, they can be the same or different molecules. In general, the number and/or type of polymers used for derivatization can be determined based on considerations including, but not limited to, the particular proper-

2. TCR-Like CARs

In some embodiments, the antibody or antigen-binding portion thereof is expressed on cells as part of a recombinant receptor, such as an antigen receptor. Among the antigen receptors are functional non-TCR antigen receptors, such as chimeric antigen receptors (CARs). Generally, a CAR containing an antibody or antigen-binding fragment that exhibits TCR-like specificity directed against a peptide in the context of an MHC molecule also may be referred to as a TCR-like CAR.

Thus, among the provided binding molecules, e.g., HPV 16 E6 or E7 binding molecules, are antigen receptors, such as those that include one of the provided antibodies, e.g., TCR-like antibodies. In some embodiments, the antigen receptors and other chimeric receptors specifically bind to a region or epitope of HPV16 E6 or E7, such as antigen receptors containing the provided anti-HPV 16 E6 or E7 antibodies or antibody fragments, e.g. TCR-like antibodies. Among the antigen receptors are functional non-TCR antigen receptors, such as chimeric antigen receptors (CARs). Also provided are cells expressing the CARs and uses thereof in adoptive cell therapy, such as treatment of diseases and disorders associated with HPV 16 E6 or E7 expression.

Thus, provided herein are TCR-like CARs that contain a non-TCR molecule that exhibits T cell receptor specificity, such as for a T cell epitope or peptide epitope when displayed or presented in the context of an MHC molecule. In some embodiments, a TCR-like CAR can contain an antibody or antigen-binding portion thereof, e.g., TCR-like antibody, such as described herein. In some embodiments, the antibody or antibody-binding portion thereof is reactive against specific peptide epitope in the context of an MHC molecule, wherein the antibody or antibody fragment can differentiate the specific peptide in the context of the MHC molecule from the MHC molecule alone, the specific peptide alone, and, in some cases, an irrelevant peptide in the context of an MHC molecule. In some embodiments, an antibody or antigen-binding portion thereof can exhibit a higher binding affinity than a T cell receptor.

Exemplary antigen receptors, including CARs, and methods for engineering and introducing such receptors into cells, include those described, for example, in international patent application publication numbers WO2000/14257, WO2013/126726, WO2012/129514, WO2014/031687, WO2013/166321, WO2013/071154, WO2013/123061 U.S. patent application publication numbers US2002/131960, US2013/287748, US2013/0149337, U.S. Pat. Nos. 6,451, 995, 7,446,190, 8,252,592, 8,339,645, 8,398,282, 7,446,179, 6,410,319, 7,070,995, 7,265,209, 7,354,762, 7,446,191, 8,324,353, and 8,479,118, and European patent application number EP2537416, and/or those described by Sadelain et al., *Cancer Discov.* 2013 April; 3(4): 388-398; Davila et al. (2013) *PLoS ONE* 8(4): e61338; Turtle et al., *Curr. Opin. Immunol.*, 2012 October; 24(5): 633-39; Wu et al., *Cancer,* 2012 Mar. 18(2): 160-75. In some aspects, the antigen receptors include a CAR as described in U.S. Pat. No. 7,446,190, and those described in International Patent Application Publication No.: WO2014/055668 A1. Exemplary of the CARs include CARs as disclosed in any of the aforementioned publications, such as WO2014/031687, U.S. Pat. Nos. 8,339,645, 7,446,179, US 2013/0149337, U.S. Pat. Nos. 7,446,190, 8,389,282, e.g., and in which the antigen-binding portion, e.g., scFv, is replaced by an antibody, e.g., as provided herein.

In some embodiments, the CARs generally include an extracellular antigen (or ligand) binding domain, including as an antibody or antigen-binding fragment thereof specific for a peptide in the context of an MHC molecule, linked to one or more intracellular signaling components, in some aspects via linkers and/or transmembrane domain(s). In some embodiments, such molecules can typically mimic or approximate a signal through a natural antigen receptor, such as a TCR, and, optionally, a signal through such a receptor in combination with a costimulatory receptor.

In some embodiments, the CAR typically includes in its extracellular portion one or more antigen binding molecules, such as one or more antigen-binding fragment, domain, or portion, or one or more antibody variable domains, and/or antibody molecules. In some embodiments, the CAR includes an antigen-binding portion or portions of an antibody molecule, such as a single-chain antibody fragment (scFv) derived from the variable heavy (VH) and variable light (VL) chains of a monoclonal antibody (mAb). In some embodiments, the CAR contains a TCR-like antibody, such as an antibody or an antigen-binding fragment (e.g., scFv) that specifically recognizes a peptide epitope presented on the cell surface in the context of an MHC molecule.

In some aspects, the antigen-specific binding, or recognition component is linked to one or more transmembrane and intracellular signaling domains. In some embodiments, the CAR includes a transmembrane domain fused to the extracellular domain of the CAR. In one embodiment, the transmembrane domain that naturally is associated with one of the domains in the CAR is used. In some instances, the transmembrane domain is selected or modified by amino acid substitution to avoid binding of such domains to the transmembrane domains of the same or different surface membrane proteins to minimize interactions with other members of the receptor complex.

The transmembrane domain in some embodiments is derived either from a natural or from a synthetic source. Where the source is natural, the domain in some aspects is derived from any membrane-bound or transmembrane protein. Transmembrane regions include those derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154. Alternatively the transmembrane domain in some embodiments is synthetic. In some aspects, the synthetic transmembrane domain comprises predominantly hydrophobic residues such as leucine and valine. In some aspects, a triplet of phenylalanine, tryptophan and valine will be found at each end of a synthetic transmembrane domain.

In some embodiments, a short oligo- or polypeptide linker, for example, a linker of between 2 and 10 amino acids in length, such as one containing glycines and serines, e.g., glycine-serine doublet, is present and forms a linkage between the transmembrane domain and the cytoplasmic signaling domain of the CAR.

In some embodiments, the CAR, e.g., TCR-like CAR, such as the antibody portion thereof, further includes a spacer, which may be or include at least a portion of an immunoglobulin constant region or variant or modified version thereof, such as a hinge region, e.g., an IgG4 hinge region, and/or a CH1/CL and/or Fc region. In some embodiments, the constant region or portion is of a human IgG, such as IgG4 or IgG1. In some aspects, the portion of the constant region serves as a spacer region between the antigen-recognition component, e.g., scFv, and transmembrane domain. The spacer can be of a length that provides for increased responsiveness of the cell following antigen binding, as compared to in the absence of the spacer. In some examples, the spacer is at or about 12 amino acids in length or is no more than 12 amino acids in length. Exemplary spacers include those having at least about 10 to 229 amino acids, about 10 to 200 amino acids, about 10 to 175 amino acids, about 10 to 150 amino acids, about 10 to 125 amino acids, about 10 to 100 amino acids, about 10 to 75 amino acids, about 10 to 50 amino acids, about 10 to 40 amino acids, about 10 to 30 amino acids, about 10 to 20 amino acids, or about 10 to 15 amino acids, and including any integer between the endpoints of any of the listed ranges. In some embodiments, a spacer region has about 12 amino acids or less, about 119 amino acids or less, or about 229 amino acids or less. Exemplary spacers include IgG4 hinge alone, IgG4 hinge linked to CH2 and CH3 domains, or IgG4 hinge linked to the CH3 domain. Exemplary spacers include, but are not limited to, those described in Hudecek et al. (2013) *Clin. Cancer Res.,* 19:3153 or international patent application publication number WO2014/031687.

In some embodiments, the constant region or portion is of a human IgG, such as IgG4 or IgG1. In some embodiments, the spacer has the sequence ESKYGPPCPPCP (set forth in SEQ ID NO: 268), and is encoded by the sequence set forth in SEQ ID NO: 269. In some embodiments, the spacer has the sequence set forth in SEQ ID NO: 270. In some embodiments, the spacer has the sequence set forth in SEQ ID NO: 271. In some embodiments, the constant region or portion is of IgD. In some embodiments, the spacer has the sequence set forth in SEQ ID NO: 272. In some embodiments, the spacer has a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS: 268, 270, 271, or 272.

The antigen recognition domain generally is linked to one or more intracellular signaling components, such as signaling components that mimic activation through an antigen receptor complex, such as a TCR complex, in the case of a CAR, and/or signal via another cell surface receptor. Thus, in some embodiments, the antibody or antigen-binding fragment thereof is linked to one or more transmembrane and intracellular signaling domains. In some embodiments, the transmembrane domain is fused to the extracellular domain. In one embodiment, a transmembrane domain that naturally is associated with one of the domains in the receptor, e.g., CAR, is used. In some instances, the transmembrane domain is selected or modified by amino acid substitution to avoid binding of such domains to the transmembrane domains of the same or different surface membrane proteins to minimize interactions with other members of the receptor complex.

The transmembrane domain in some embodiments is derived either from a natural or from a synthetic source. Where the source is natural, the domain in some aspects is derived from any membrane-bound or transmembrane protein. Transmembrane regions include those derived from (i.e. comprise at least the transmembrane region(s) of) the alpha, beta or zeta chain of the T-cell receptor, CD28, CD3 epsilon, CD45, CD4, CD5, CD8, CD9, CD 16, CD22, CD33, CD37, CD64, CD80, CD86, CD134, CD137, CD154. Alternatively the transmembrane domain in some embodiments is synthetic. In some aspects, the synthetic transmembrane domain comprises predominantly hydrophobic residues such as leucine and valine. In some aspects, a triplet of phenylalanine, tryptophan and valine will be found at each end of a synthetic transmembrane domain. In some embodiments, the linkage is by linkers, spacers, and/or transmembrane domain(s).

Among the intracellular signaling domains are those that mimic or approximate a signal through a natural antigen receptor, a signal through such a receptor in combination with a costimulatory receptor, and/or a signal through a costimulatory receptor alone. In some embodiments, a short oligo- or polypeptide linker, for example, a linker of between 2 and 10 amino acids in length, such as one containing glycines and serines, e.g., glycine-serine doublet, is present and forms a linkage between the transmembrane domain and the cytoplasmic signaling domain of the CAR.

The CAR generally includes at least one intracellular signaling component or components. In some embodiments, the CAR includes an intracellular component of the TCR complex, such as a TCR CD3$^+$ chain that mediates T-cell activation and cytotoxicity, e.g., CD3 zeta chain. Thus, in some aspects, the antigen binding molecule is linked to one or more cell signaling modules. In some embodiments, cell signaling modules include CD3 transmembrane domain, CD3 intracellular signaling domains, and/or other CD transmembrane domains. In some embodiments, the CAR further includes a portion of one or more additional molecules such as Fc receptor γ, CD8, CD4, CD25, or CD16. For example, in some aspects, the CAR includes a chimeric molecule between CD3-zeta (CD3-ζ) or Fc receptor γ and CD8, CD4, CD25 or CD16.

In some embodiments, upon ligation of the CAR, the cytoplasmic domain or intracellular signaling domain of the CAR activates at least one of the normal effector functions or responses of the immune cell, e.g., T cell engineered to express the CAR. For example, in some contexts, the CAR induces a function of a T cell such as cytolytic activity or T-helper activity, such as secretion of cytokines or other factors. In some embodiments, a truncated portion of an intracellular signaling domain of an antigen receptor component or costimulatory molecule is used in place of an intact immunostimulatory chain, for example, if it transduces the effector function signal. In some embodiments, the intracellular signaling domain or domains include the cytoplasmic sequences of the T cell receptor (TCR), and in some aspects also those of co-receptors that in the natural context act in concert with such receptor to initiate signal transduction following antigen receptor engagement, and/or any derivative or variant of such molecules, and/or any synthetic sequence that has the same functional capability.

In the context of a natural TCR, full activation generally requires not only signaling through the TCR, but also a costimulatory signal. Thus, in some embodiments, to promote full activation, a component for generating secondary or co-stimulatory signal is also included in the CAR. In other embodiments, the CAR does not include a component for generating a costimulatory signal. In some aspects, an additional CAR is expressed in the same cell and provides the component for generating the secondary or costimulatory signal. In some aspects, the cell comprises a first CAR which contains signaling domains to induce the primary signal and a second CAR which binds to a second antigen and contains the component for generating a costimulatory signal. For example, a first CAR can be an activating CAR and the second CAR can be a costimulatory CAR. In some aspects, both CARs must be ligated in order to induce a particular effector function in the cell, which can provide specificity and selectivity for the cell type being targeted.

T cell activation is in some aspects described as being mediated by two classes of cytoplasmic signaling sequences: those that initiate antigen-dependent primary activation through the TCR (primary cytoplasmic signaling sequences), and those that act in an antigen-independent manner to provide a secondary or co-stimulatory signal (secondary cytoplasmic signaling sequences). In some aspects, the CAR includes one or both of such signaling components.

In some aspects, the CAR includes a primary cytoplasmic signaling sequence that regulates primary activation of the TCR complex. Primary cytoplasmic signaling sequences that act in a stimulatory manner may contain signaling motifs which are known as immunoreceptor tyrosine-based activation motifs or ITAMs. Examples of ITAM containing primary cytoplasmic signaling sequences include those derived from TCR or CD3 zeta, FcR gamma, CD3 gamma, CD3 delta or CD3 epsilon. In some embodiments, cytoplasmic signaling molecule(s) in the CAR contain(s) a cytoplasmic signaling domain, portion thereof, or sequence derived from CD3 zeta.

In some embodiments, the CAR includes a signaling domain and/or transmembrane portion of a costimulatory receptor, such as CD28, 4-1BB, OX40, DAP10, and ICOS. In some aspects, the same CAR includes both the activating and costimulatory components; in other aspects, the activating domain is provided by one CAR whereas the costimulatory component is provided by another CAR recognizing another antigen.

In some embodiments, the activating domain is included within one CAR, whereas the costimulatory component is provided by another chimeric receptor recognizing another antigen. In some embodiments, the CARs include activating or stimulatory CARs, and costimulatory receptors, both expressed on the same cell (see WO2014/055668). In some aspects, the HPV 16 E6 or E7 antibody-containing receptor is the stimulatory or activating CAR; in other aspects, it is the costimulatory receptor. In some embodiments, the cells further include inhibitory CARs (iCARs, see Fedorov et al., *Sci. Transl. Medicine,* 5(215) (December, 2013)), such as an inhibitory receptor recognizing a peptide epitope other than HPV 16 E6 or HPV16 E7, whereby an activating signal delivered through the HPV 16-targeting CAR is diminished or inhibited by binding of the inhibitory CAR to its ligand, e.g., to reduce off-target effects.

In some embodiments, the cell expressing the provided TCR or other binding molecule further expresses an additional receptor, such as a receptor capable of delivering a costimulatory or survival-promoting signal, such as a costimulatory receptor (see WO2014/055668) and/or to block or change the outcome of an inhibitory signal, such as one typically delivered via an immune checkpoint or other immunoinhibitory molecule, such as one expressed in the tumor microenvironment, e.g., in order to promote increased efficacy of such engineered cells. See, e.g., Tang et al., Am J Transl Res. 2015; 7(3): 460-473. In some embodiments, the cell may further include one or more other exogenous or recombinant or engineered components, such as one or more exogenous factors and/or costimulatory ligands, which are expressed on or in or secreted by the cells and can promote function, e.g., in the microenviroment. Exemplary of such ligands and components include, e.g., TNFR and/or Ig family receptors or ligands, e.g., 41BBL, CD40, CD40L, CD80, CD86, cytokines, chemokines, and/or antibodies or other molecules, such as scFvs. See, e.g., patent application publication Nos WO2008121420 A1, WO2014134165 A1, US20140219975 A1. In some embodiments, the cells comprise one or more inhibitory receptor (iCARs, see Fedorov et al., *Sci. Transl. Medicine,* 5(215) (December, 2013)), such as one that binds to a ligand or antigen not associated with the disease or condition or not expressed therein or thereon.

In certain embodiments, the intracellular signaling domain comprises a CD28 transmembrane and signaling domain linked to a CD3 (e.g., CD3-zeta) intracellular domain. In some embodiments, the intracellular signaling domain comprises a chimeric CD28 and CD137 (4-1BB, TNFRSF9) co-stimulatory domains, linked to a CD3 zeta intracellular domain.

In some embodiments, the CAR encompasses one or more, e.g., two or more, costimulatory domains and an activation domain, e.g., primary activation domain, in the cytoplasmic portion. Exemplary CARs include intracellular components of CD3-zeta, CD28, and 4-1BB.

In some embodiments, the cell expressing the CAR or other antigen receptor further includes a marker, such as a cell surface marker, which may be used to confirm transduction or engineering of the cell to express the receptor, such as a truncated version of a cell surface receptor, such as truncated EGFR (tEGFR). Exemplary surrogate markers can include truncated forms of cell surface polypeptides, such as truncated forms that are non-functional and to not transduce or are not capable of transducing a signal or a signal ordinarily transduced by the full-length form of the cell surface polypeptide, and/or do not or are not capable of internalizing Exemplary truncated cell surface polypeptides including truncated forms of growth factors or other receptors such as a truncated human epidermal growth factor receptor 2 (tHER2), a truncated epidermal growth factor receptor (tEGFR, exemplary tEGFR sequence set forth in SEQ ID NO: 273 or 343) or a prostate-specific membrane antigen (PSMA) or modified form thereof tEGFR may contain an epitope recognized by the antibody cetuximab (Erbitux®) or other therapeutic anti-EGFR antibody or binding molecule, which can be used to identify or select cells that have been engineered with the tEGFR construct and an encoded exogenous protein, and/or to eliminate or separate cells expressing the encoded exogenous protein. See U.S. Pat. No. 8,802,374 and Liu et al., Nature Biotech. 2016 April; 34(4): 430-434). In some aspects, the marker, e.g. surrogate marker, includes all or part (e.g., truncated form) of CD34, a NGFR, a CD19 or a truncated CD19, e.g., a truncated non-human CD19, or epidermal growth factor receptor (e.g., tEGFR). In some embodiments, the marker is or comprises a fluorescent protein, such as green fluorescent protein (GFP), enhanced green fluorescent protein (EGFP), such as super-fold GFP (sfGFP), red fluorescent protein (RFP), such as tdTomato, mCherry, mStrawberry, AsRed2, DsRed or DsRed2, cyan fluorescent protein (CFP), blue green fluorescent protein (BFP), enhanced blue fluorescent protein (EBFP), and yellow fluorescent protein (YFP), and variants thereof, including species variants, monomeric variants, and codon-optimized and/or enhanced variants of the fluorescent proteins. In some embodiments, the marker is or comprises an enzyme, such as a luciferase, the lacZ gene from *E. coli*, alkaline phosphatase, secreted embryonic alkaline phosphatase (SEAP), chloramphenicol acetyl transferase (CAT). Exemplary light-emitting reporter genes include luciferase (luc), β-galactosidase, chloramphenicol acetyltransferase (CAT), β-glucuronidase (GUS) or variants thereof.

In some embodiments, the marker is a selection marker. In some embodiments, the selection marker is or comprises a polypeptide that confers resistance to exogenous agents or drugs. In some embodiments, the selection marker is an antibiotic resistance gene. In some embodiments, the selection marker is an antibiotic resistance gene confers antibiotic resistance to a mammalian cell. In some embodiments, the selection marker is or comprises a Puromycin resistance gene, a Hygromycin resistance gene, a Blasticidin resistance gene, a Neomycin resistance gene, a Geneticin resistance gene or a Zeocin resistance gene or a modified form thereof.

In some aspects, the marker includes all or part (e.g., truncated form) of CD34, a NGFR, or epidermal growth factor receptor (e.g., tEGFR). In some embodiments, the nucleic acid encoding the marker is operably linked to a polynucleotide encoding for a linker sequence, such as a cleavable linker sequence, e.g., T2A. See WO2014031687. In some embodiments, introduction of a construct encoding the CAR and EGFRt separated by a T2A ribosome switch can express two proteins from the same construct, such that the EGFRt can be used as a marker to detect cells expressing such construct. In some embodiments, a marker, and optionally a linker sequence, can be any as disclosed in published patent application No. WO2014031687. For example, the marker can be a truncated EGFR (tEGFR) that is, optionally, linked to a linker sequence, such as a T2A cleavable linker sequence. An exemplary polypeptide for a truncated EGFR (e.g. tEGFR) comprises the sequence of amino acids set forth in SEQ ID NO: 273 or 343 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 273 or 343. An exemplary T2A linker sequence comprises the sequence of amino acids set forth in SEQ ID NO: 211 or 274 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 211 or 274.

In some embodiments, the marker is a molecule, e.g., cell surface protein, not naturally found on T cells or not naturally found on the surface of T cells, or a portion thereof.

In some embodiments, the molecule is a non-self molecule, e.g., non-self protein, i.e., one that is not recognized as "self" by the immune system of the host into which the cells will be adoptively transferred.

In some embodiments, the marker serves no therapeutic function and/or produces no effect other than to be used as a marker for genetic engineering, e.g., for selecting cells successfully engineered. In other embodiments, the marker may be a therapeutic molecule or molecule otherwise exerting some desired effect, such as a ligand for a cell to be encountered in vivo, such as a costimulatory or immune checkpoint molecule to enhance and/or dampen responses of the cells upon adoptive transfer and encounter with ligand.

In some cases, CARs are referred to as first, second, and/or third generation CARs. In some aspects, a first generation CAR is one that solely provides a CD3-chain induced signal upon antigen binding; in some aspects, a second-generation CARs is one that provides such a signal and costimulatory signal, such as one including an intracellular signaling domain from a costimulatory receptor such as CD28 or CD137; in some aspects, a third generation CAR in some aspects is one that includes multiple costimulatory domains of different costimulatory receptors.

In some embodiments, the chimeric antigen receptor includes an extracellular portion containing a TCR-like antibody or fragment described herein and an intracellular signaling domain. In some embodiments, the antibody or fragment includes a scFv and the intracellular domain contains an ITAM. In some aspects, the intracellular signaling domain includes a signaling domain of a zeta chain of a CD3-zeta (CD3ζ) chain. In some embodiments, the chimeric antigen receptor includes a transmembrane domain linking the extracellular domain and the intracellular signaling domain. In some aspects, the transmembrane domain contains a transmembrane portion of CD28. The extracellular domain and transmembrane can be linked directly or indirectly. In some embodiments, the extracellular domain and transmembrane are linked by a spacer, such as any described herein. In some embodiments, the chimeric antigen receptor contains an intracellular domain of a T cell costimulatory molecule, such as between the transmembrane domain and intracellular signaling domain. In some aspects, the T cell costimulatory molecule is CD28 or 41BB.

For example, in some embodiments, the CAR contains a TCR-like antibody, e.g., an antibody fragment, as provided herein, a transmembrane domain that is or contains a transmembrane portion of CD28 or a functional variant thereof, and an intracellular signaling domain containing a signaling portion of CD28 or functional variant thereof and a signaling portion of CD3 zeta or functional variant thereof. In some embodiments, the CAR contains a TCR-like antibody, e.g., antibody fragment, as provided herein, a transmembrane domain that is or contains a transmembrane portion of CD28 or a functional variant thereof, and an intracellular signaling domain containing a signaling portion of a 4-1BB or functional variant thereof and a signaling portion of CD3 zeta or functional variant thereof. In some such embodiments, the CAR further includes a spacer containing a portion of an Ig molecule, such as a human Ig molecule, such as an Ig hinge, e.g. an IgG4 hinge, such as a hinge-only spacer.

In some embodiments, the transmembrane domain of the receptor, e.g., the TCR-like CAR, is a transmembrane domain of human CD28 (e.g., Accession No. P01747.1) or variant thereof, such as a transmembrane domain that comprises the sequence of amino acids set forth in SEQ ID NO: 275 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 275. In some embodiments, the transmembrane-domain containing portion of the CAR comprises the sequence of amino acids set forth in SEQ ID NO: 276 or a sequence of amino acids having at least at or about 85%, 86%, 87%, 88%, 89%, 90%, 91%, 92%, 93%, 94%, 95%, 96%, 97%, 98%, 99% or more sequence identity to SEQ ID NO: 276.

In some embodiments, the intracellular signaling component(s) of the CAR, e.g., the TCR-like CAR, contains an intracellular costimulatory signaling domain of human CD28 or a functional variant or portion thereof, such as a domain with an LL to GG substitution at positions 186-187 of a native CD28 protein. For example, the intracellular signaling domain can comprise the sequence of amino acids set forth in SEQ ID NO: 277 or 278 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 277 or 278. In some embodiments, the intracellular domain comprises an intracellular costimulatory signaling domain of 4-1BB (e.g. (Accession No. Q07011.1) or functional variant or portion thereof, such as the sequence of amino acids set forth in SEQ ID NO: 279 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 279.

In some embodiments, the intracellular signaling domain of the CAR, e.g. the TCR-like CAR, comprises a human CD3 zeta stimulatory signaling domain or functional variant thereof, such as an 112 AA cytoplasmic domain of isoform 3 of human CD3 (Accession No.: P20963.2) or a CD3 zeta signaling domain as described in U.S. Pat. No. 7,446,190 or 8,911,993. For example, in some embodiments, the intracellular signaling domain comprises the sequence of amino acids of SEQ ID NO: 280, 281, or 282, or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 280, 281, or 282.

In some aspects, the spacer contains only a hinge region of an IgG, such as only a hinge of IgG4 or IgG1, such as the hinge only spacer set forth in SEQ ID NO: 268. In other embodiments, the spacer is or contains an Ig hinge, e.g., an IgG4-derived hinge, optionally linked to a CH2 and/or CH3 domains. In some embodiments, the spacer is an Ig hinge, e.g., an IgG4 hinge, linked to CH2 and CH3 domains, such as set forth in SEQ ID NO: 271. In some embodiments, the spacer is an Ig hinge, e.g., an IgG4 hinge, linked to a CH3 domain only, such as set forth in SEQ ID NO: 270. In some embodiments, the spacer is or comprises a glycine-serine rich sequence or other flexible linker such as known flexible linkers.

For example, in some embodiments, the TCR-like CAR includes a TCR-like antibody or fragment, such as any provided herein, including scFvs, a spacer such as any of the Ig-hinge containing spacers, a CD28 transmembrane domain, a CD28 intracellular signaling domain, and a CD3 zeta signaling domain. In some embodiments, the TCR-like CAR includes the a TCR-like antibody or fragment, such as any provided herein, including scFvs, a spacer such as any of the Ig-hinge containing spacers, a CD28 transmembrane domain, a CD28 intracellular signaling domain, and a CD3 zeta signaling domain. In some embodiments, such TCR-like CAR constructs further includes a T2A ribosomal skip element and/or a tEGFR sequence, e.g., downstream of the CAR.

In some embodiments, such CAR constructs further includes a T2A ribosomal skip element and/or a tEGFR sequence, e.g., downstream of the CAR, such as set forth in SEQ ID NO: 211 or 274 and a tEGFR sequence set forth in SEQ ID NO: 273 or 343, or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 211, 273, 343, or 274.

In some embodiments, the CAR includes an HPV 16 E6 or E7 antibody or fragment, such as any of the HPV16 E6 or E7 antibodies, including sdAbs (e.g. containing only the $V_H$ region) and scFvs, described herein, a spacer such as any of the Ig-hinge containing spacers, a CD28 transmembrane domain, a CD28 intracellular signaling domain, and a CD3 zeta signaling domain. In some embodiments, the CAR includes the HPV 16 antibody or fragment, such as any of the HPV 16 E6 or E7 antibodies, including sdAbs and scFvs described herein, a spacer such as any of the Ig-hinge containing spacers, a CD28 transmembrane domain, a CD28 intracellular signaling domain, and a CD3 zeta signaling domain. In some embodiments, such CAR constructs further includes a T2A ribosomal skip element and/or a tEGFR sequence, e.g., downstream of the CAR.

3. Exemplary Features of Bin Ding Molecules and Engineered Cells

In some aspects, the provided binding molecules, e.g. TCRs or TCR-like CAR have one or more specified functional features, such as binding properties, including binding to particular epitopes, lack of off-target binding or activity and/or particular binding affinities. In some embodiments, any one or more of the features of a provided TCR can be assessed by expressing the TCR, e.g., by introducing one or more nucleic acid encoding the TCR, into a T cell, such a primary T cell or a T cell line. In some embodiments, the T cell line is a Jurkat cell or a Jurkat-derived cell line. Exemplary of a Jurkat-derived cell line is the J.RT3-T3.5 (ATCC® TIB-153TM) cell line, produced by treatment of the Jurkat leukemia cell line with irradiation mutagenesis and negative selection with OKT3 monoclonal antibody (see Weiss & Stobo, J. Ex. Med. 160(5):1284-1299 (1984)).

In some embodiments, the provided binding molecules are capable of binding to a peptide epitope of HPV16, e.g. an epitope of HPV 16 E6 or E7 such as described above, with at least a certain affinity, as measured by any of a number of known methods. In some embodiments, the peptide epitope is a peptide in the context of an MHC molecule or ligand. In some embodiments, the affinity is represented by an equilibrium dissociation constant ($K_D$) or an association constant ($k_a$). In some embodiments, the affinity is represented by $EC_{50}$.

In some embodiments, the binding molecule, e.g., TCR, binds, such as specifically binds, to a peptide epitope, e.g., in complex with an MHC molecule, with an affinity or $K_A$ (i.e., an equilibrium association constant of a particular binding interaction with units of 1/M; equal to the ratio of the on-rate [$k_{on}$ or $k_a$] to the off-rate [$k_{off}$ or $k_d$] for this association reaction, assuming bimolecular interaction) equal to or greater than $10^5$ M$^{-1}$. In some embodiments, the TCR or fragment thereof exhibits a binding affinity for the peptide epitope with a $K_D$ (i.e., an equilibrium dissociation constant of a particular binding interaction with units of M; equal to the ratio of the off-rate [$k_{off}$ or $k_d$] to the on-rate [$k_{on}$ or $k_a$] for this association reaction, assuming bimolecular interaction) of equal to or less than $10^{-5}$ M. For example, the equilibrium dissociation constant $K_D$ ranges from or from about $10^{-5}$ M to or to about $10^{-12}$ M, such as from or from about $10^{-6}$ M to or to about $10^{-10}$ M, from or from about $10^{-7}$ M to or to about $10^{-11}$ M, from or from about $10^{-6}$ M to or to about $10^{-8}$ M, or from or from about $10^{-7}$ M to or to about $10^{-8}$ M. The on-rate (association rate constant; $k_{on}$ or $k_a$; units of 1/Ms) and the off-rate (dissociation rate constant; $k_{off}$ or $k_d$; units of 1/s) can be determined using any of the assay methods known in the art, for example, surface plasmon resonance (SPR).

In some embodiments, binding affinity may be classified as high affinity or as low affinity. In some cases, the binding molecule (e.g. TCR) that exhibits low to moderate affinity binding exhibits a $K_A$ of up to $10^7$ M$^{-1}$, up to $10^6$ M$^{-1}$, up to $10^5$ M$^{-1}$. In some cases, a binding molecule (e.g. TCR) that exhibits high affinity binding to a particular epitope interacts with such epitope with a $K_A$ of at least $10^7$ M$^{-1}$, at least $10^8$ M$^{-1}$, at least $10^9$ M$^{-1}$, at least $10^{10}$ M$^{-1}$, at least $10^{11}$ M$^{-1}$, at least $10^{12}$ M$^{-1}$, or at least $10^{13}$ M$^{-1}$. In some embodiments, the binding affinity ($EC_{50}$) and/or the dissociation constant of the binding molecule to a peptide epitope of HPV 16 E6 or E7 is from or from about 0.1 nM to 1 µM, 1 nM to 1 µM, 1 nM to 500 nM, 1 nM to 100 nM, 1 nM to 50 nM, 1 nM to 10 nM, 10 nM to 500 nM, 10 nM to 100 nM, 10 nM to 50 nM, 50 nM to 500 nM, 50 nM to 100 nM or 100 nM to 500 nM. In certain embodiments, the binding affinity ($EC_{50}$) and/or the dissociation constant of the binding molecule to a peptide epitope of HPV 16 E6 or E7 is at or about or less than at or about 1 µM, 500 nm, 100 nM, 50 nM, 40 nM, 30 nM, 25 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, or 1 nM.

A variety of assays are known for assessing binding affinity and/or determining whether a binding molecule specifically binds to a particular ligand (e.g. peptide in the context of an MHC molecule). It is within the level of a skilled artisan to determine the binding affinity of a binding molecule, e.g., TCR, for a T cell epitope of a target polypeptide, such as by using any of a number of binding assays that are well known in the art. For example, in some embodiments, a BIAcore machine can be used to determine the binding constant of a complex between two proteins. The dissociation constant for the complex can be determined by monitoring changes in the refractive index with respect to time as buffer is passed over the chip. Other suitable assays for measuring the binding of one protein to another include, for example, immunoassays such as enzyme linked immunosorbent assays (ELISA) and radioimmunoassays (RIA), or determination of binding by monitoring the change in the spectroscopic or optical properties of the proteins through fluorescence, UV absorption, circular dichroism, or nuclear magnetic resonance (NMR). Other exemplary assays include, but are not limited to, Western blot, ELISA, analytical ultracentrifugation, spectroscopy and surface plasmon resonance (Biacore®) analysis (see, e.g., Scatchard et al., *Ann. N.Y. Acad. Sci.* 51:660, 1949; Wilson, *Science* 295:2103, 2002; Wolff et al., *Cancer Res.* 53:2560, 1993; and U.S. Pat. Nos. 5,283,173, 5,468,614, or the equivalent), flow cytometry, sequencing and other methods for detection of expressed nucleic acids. In one example, apparent affinity for a TCR is measured by assessing binding to various concentrations of tetramers, for example, by flow cytometry using labeled tetramers. In one example, apparent $K_D$ of a TCR is measured using 2-fold dilutions of labeled tetramers at a range of concentrations, followed by determination of binding curves by non-linear regression, apparent $K_D$ being determined as the concentration of ligand that yielded half-maximal binding.

In some embodiments, the binding molecules display a binding preference for antigen recognition of HPV 16 E6- or E7-expressing cells as compared to HPV 16 E6- or E7-negative cells, such as particular cells known and/or described herein to express HPV 16 E6 or E7 and known not to express HPV 16 E6 or E7. In some embodiments, the binding preference is observed where a significantly greater degree of binding is measured to the HPV 16 E6- or E7-expressing, as compared to the non-HPV 16 E6- or E7-expressing cells. In some embodiments, the fold change in degree of binding detected, for example, as measured by mean fluorescence intensity in a flow cytometry-based assay and/or dissociation constant or $EC_{50}$, to the HPV 16 E6- or E7-expressing cells as compared to the non-HPV 16 E6- or E7-expressing cells, is at least at or about 1.5, 2, 3, 4, 5, 6, or more.

In some embodiments, the binding molecule, e.g. TCR, does not exhibit cross-reactive or off-target binding, such as undesirable off-target binding, e.g. off-target binding to antigens present in healthy or normal tissues or cells. In some embodiments, the binding molecule, e.g. TCR, recognizes, such as specifically binds, only one peptide epitope or antigen complex, such as recognizes only a particular HPV 16 E6 or E7 epitope set forth in any of SEQ ID NOs: 232-239 or an antigen complex thereof. Thus, in some embodiments, the provided binding molecules, e.g. TCRs, have a reduced risk of causing unwanted side effects due to, for example, recognition of a non-target peptide epitope.

In some embodiments, the binding molecule, e.g., TCR, does not recognize, such as does not specifically bind, a sequence-related peptide epitope of the HPV 16 E6 or E7 epitope set forth in any of SEQ ID NOS: 232-239, i.e., does not recognize an epitope sharing some amino acids in common with an HPV 16 E6 or E7 epitope set forth in any of SEQ ID NOS: 232-239, such as does not recognize an epitope that differs in 1, 2, 3, 4, 5 or 6 amino acid residues from such epitope when the epitopes are aligned. In some embodiments, the binding molecule, e.g., TCR, does not recognize a sequence-unrelated epitope of the HPV 16 E6 or E7 epitope set forth in any of SEQ ID NOS: 232-239, i.e., does not recognize an epitope that is substantially different in sequence compared to an HPC 16 E6 or E7 epitope set forth in any of SEQ ID NOS: 232-239, such as differing in more than 6, 7, 8, 9, 10 or more amino acid residues from such epitope when the epitopes are aligned. In some embodiments, the binding molecule, e.g., TCR, does not recognize the HPV 16 E6 or E7 epitope set forth in any of SEQ ID NOS: 232-239 in the context of a different MHC allele, such as in the context of an MHC allele other than HLA-A2.

Typically, specific binding of binding molecule, e.g. TCR, to a peptide epitope, e.g. in complex with an MHC, is governed by the presence of an antigen-binding site containing one or more complementarity determining regions (CDRs). In general, it is understood that specifically binds does not mean that the particular peptide epitope, e.g. in complex with an MHC, is the only thing to which the MHC-peptide molecule may bind, since non-specific binding interactions with other molecules may also occur. In some embodiments, binding of binding molecule to a peptide in the context of an MHC molecule is with a higher affinity than binding to such other molecules, e.g. another peptide in the context of an MHC molecule or an irrelevant (control) peptide in the context of an MHC molecule, such as at least about 2-fold, at least about 10-fold, at least about 20-fold, at least about 50-fold, or at least about 100-fold higher than binding affinity to such other molecules.

In some embodiments, the binding molecule, e.g., TCR, can be assessed for safety or off-target binding activity using any of a number of screening assays known in the art. In some embodiments, generation of an immune response to a particular binding molecule, e.g., TCR, can be measured in the presence of cells that are known not to express the target peptide epitope, such as cells derived from normal tissue(s), allogenic cell lines that express one or more different MHC types or other tissue or cell sources. In some embodiments, the cells or tissues include normal cells or tissues. For example, in some cases, cells or tissues can include brain, muscle, liver, colon, kidney, lung, ovary, placenta, heart, pancreas, prostate, epithelium or skin, testis, adrenal, intestine, bone marrow or spleen. In some embodiments, the binding to cells can be tested in 2 dimensional cultures. In some embodiments, the binding to cells can be tested in 3 dimensional cultures. In some embodiments, as a control, the tissues or cells can be ones that are known to express the target epitope. The immune response can be assessed directly or indirectly, such as by assessing activation of immune cells such as T cells (e.g. cytotoxic activity), production of cytokine (e.g. interferon gamma), or activation of a signaling cascade.

In some embodiments, potential off-targets can be identified by performing a homology scan of the human genome using the particular target epitope, e.g., to identify potential sequence-related epitopes. In some cases, a protein sequence database can be analyzed to identify peptides with similarity to the target peptide epitope. In some embodiments, to facilitate identification of potential sequence-related epitopes of interest, a binding motif can first be identified. In some embodiments, the binding motif can be identified by peptide scanning, such as an alanine mutagenesis scan, of the target epitope (e.g., HPV 16 E6 or E7 epitope set forth in any of SEQ ID NOS: 232-239) to identify the binding motif recognized by the binding molecule, see e.g. WO2014/

096803. In some embodiments, the binding motif can be identified by mutagenesis of the target peptide so that a series of mutants are generated in which each amino acid or a subset thereof is changed to another amino acid residue, tested for its activity relative to the original target epitope, and those residues that are involved in or required for binding are identified. In some embodiments, a series of mutants may be made in which the amino acid residue at each position of the target epitope is mutated to all alternative amino acids. In some cases, once the binding motif is identified (i e amino acid residues that are non-tolerated and are involved in or are required for binding), protein databases may be searched for proteins that contain the binding motif.

In some embodiments, suitable protein databases include but are not limited to UniProtKB/Swiss-Prot (http://www.uniprot.org/), Protein Information Resource (PI R) (http://pir.georgetown.edu/pirwww/index.shtml), and/or Reference Sequence (RefSeq) (www.ncbi.nlm.nih.gov/RefSeq). Searching for a peptide motif may be carried out using any one of a number of tools, which may be found on bioinformatics resource sites such as ExPASY (http://www-.expasy.org/). For example, the search tool ScanProsite identifies user-defined motifs in all protein sequences in the UniProtKB/Swiss-Prot Protein Knowledgebase (De Castro et al. Nucleic Acids Res. 2006 Jul. 1; 34 (Web Server issue):W362-5). In some cases, the search may be carried out for peptides that are of human origin or of organisms which are commonly present in humans, such as viral or bacterial pathogens, or commensal bacteria.

In some embodiments, if a potential off-target epitope is identified, the binding molecule, e.g., TCR, can be redesigned so that there is no longer any cross reactivity to the off target peptide(s), while maintaining binding, preferably with high affinity, to the target peptide epitope. For example, T cell receptors can be redesigned by mutagenesis using the methods described in WO 03/020763.

In some embodiments, the binding molecules, e.g., engineered cells comprising the binding molecules, e.g., TCRs, elicit an immune response to HPV 16. In some embodiments, cytotoxic T lymphocytes (CTL) may be activated when cells containing the binding molecules, e.g., TCRs, are contacted with target cells, such as those that express HPV 16, such as HPV 16 E6 or HPV 16 E7. For example, cells containing the TCRs may induce lysis of target cells, such as HPV 16-expressing, e.g., HPV 16 E6- or E7-expressing cells. In some aspects, the ability of the binding molecules, such as cells expressing the binding molecules, e.g., TCRs or CARs, to elicit an immune response can be determined by measuring cytokine release. In some embodiments, in response to coculture with or exposure to cells expressing the binding molecules, e.g., TCRs or CARs, a variety of cytokines are released when the cells are stimulated by an appropriate target cell known to express HPV 16, such as HPV 16 E6 or HPV 16 E7. Non-limiting examples of such cytokines include IFN-γ, TNF-α, and GM-CSF. Exemplary cells known to express HPV 16 include, but are not limited to, CaSki cells (ATCC No. CRL-1550, which contain about 600 copies of integrated HPV16) or other tumor cell expressing the relevant MHC molecule and the corresponding peptide epitope, e.g., HPV 16 E6 or E7 epitope, such as any of those set forth in SEQ ID NOs: 232-239.

In some embodiments, CTL activation can be determined. A variety of techniques exist for assaying the activity of CTL. In some embodiments, CTL activity can be assessed by assaying the culture for the presence of CTLs that lyse radio-labeled target cells, such as specific peptide-pulsed targets. These techniques include the labeling of target cells with radionuclides such as $Na_2$, $^{51}CrO_4$ or $^3$H-thymidine, and measuring the release or retention of the radionuclides from the target cells as an index of cell death. In some embodiments, CTL are known to release a variety of cytokines when they are stimulated by an appropriate target cell, such as a tumor cell expressing the relevant MHC molecule and the corresponding peptide epitope, and the presence of such epitope-specific CTLs can be determined by measuring cytokine release. Non-limiting examples of such cytokines include IFN-γ, TNF-α, and GM-CSF. Assays for these cytokines are well known in the art, and their selection is left to the skilled artisan. Methodology for measuring both target cell death and cytokine release as a measure of CTL reactivity are given in Coligan, J. E. et al. (Current Protocols in Immunology, 1999, John Wiley & Sons, Inc., New York).

In some embodiments, cytokine production can be measured as an indicator of an immune response. In some cases, such measured cytokines can include, without limitation, interleukin-2 (IL-2), interferon-gamma (IFNγ), interleukin-4 (IL-4), TNF-alpha, interleukin-6 (IL-6), interleukin-10 (IL-10), interleukin-12 (IL-12) or TGF-beta. Assays to measure cytokines are well known in the art, and include, without limitation, ELISA, intracellular cytokine staining, cytometric bead array, RT-PCR, ELISPOT, flow cytometry and bio-assays in which cells responsive to the relevant cytokine are tested for responsiveness (e.g. proliferation) in the presence of a test sample.

In some embodiments, cells exposed to the binding molecules, e.g. cells containing the binding molecules, such as TCRs or CARs, are assessed for an immunological readout, such as using a T cell assay. In some embodiments, the binding molecule-containing cells can activate a CD8+ T cell response. In one embodiment, CD8+ T cell responses can be assessed by monitoring CTL reactivity using assays that include, but are not limited to, target cell lysis via $^{51}$Cr release or detection of interferon gamma release, such as by enzyme-linked immunosorbent spot assay (ELISA), intracellular cytokine staining or ELISPOT. In some embodiments, the binding molecules, e.g., cells containing the binding molecules, such as TCRs or CARs, can activate a CD4+ T cell response. In some aspects, CD4+ T cell responses can be assessed by assays that measure proliferation, such as by incorporation of [31-1]-thymidine into cellular DNA and/or by the production of cytokines, such as by ELISA, intracellular cytokine staining or ELISPOT. In some cases, the cytokine can include, for example, interleukin-2 (IL-2), interferon-gamma (IFN-gamma), interleukin-4 (IL-4), TNF-alpha, interleukin-6 (IL-6), interleukin-10 (IL-10), interleukin-12 (IL-12) or TGF beta. In some embodiments, recognition or binding of the peptide epitope, such as a MHC class II epitope, by the binding molecule can elicit or activate a CD4+ T cell response and/or a CD8+ T cell response.

In some embodiments, the binding specificity and/or function (e.g., ability to elicit an immune response to HPV 16) of the binding molecule, e.g., TCR or antigen-binding fragment thereof, is at least partially CD8-independent. In some cases, TCR recognition of a peptide in the context of an MHC molecule and subsequent T cell activation is facilitated in the presence of a CD8 co-receptor. For example, CD8 coreceptor engagement can facilitate low—to moderate—TCR affinity interactions and/or T cell activation (See, for example, Kerry et al. J. Immunology (2003) 171(9): 4493-4503 and Robbins et al. J Immunology (2008) 180(9): 6116-6131). Among the provided binding molecules are molecules, e.g. TCRs, that exhibit CD8-independent binding for an HPV E6 or E7 peptide epitope. In some embodiments, such binding molecules, e.g. TCR, may have higher functional avidity or affinity than TCRs or antigen binding fragments thereof that require the presence of CD8 co-expression. In some aspects, the provided CD8-independent binding molecules, such as TCRs, can be expressed or engineered in cells, e.g. T cells, that do not express CD8, such as can be expressed or engineered in CD4+ cells. In some embodiments, among the provided engineered non-CD8-expressing cells, e.g. CD4+ cells, are cells expressing a recombinant binding molecule, e.g., TCR or antigen-binding fragment, that exhibit at least or at least about 20%, 30%, 40%, 50%, 60%, 70%, 80%, 90% or more of the binding specificity, affinity and/or avidity for a peptide in the context of an MHC molecule as the same binding molecule (e.g., TCR or antigen-binding fragment thereof) that is expressed on a CD8+ T cell.

II. Nucleic Acids, Vectors and Methods of Expression

Also provided are nucleic acids encoding any of the provided binding molecules, e.g., TCRs or antigen-binding fragments thereof or antibodies or antigen-binding fragments thereof or CARs containing such antibodies, such as those described herein. The nucleic acids may include those encompassing natural and/or non-naturally occurring nucleotides and bases, e.g., including those with backbone modifications. The terms "nucleic acid molecule," "nucleic acid," and "polynucleotide" may be used interchangeably, and refer to a polymer of nucleotides. Such polymers of nucleotides may contain natural and/or non-natural nucleotides, and include, but are not limited to, DNA, RNA, and PNA. "Nucleic acid sequence" refers to the linear sequence of nucleotides that comprise the nucleic acid molecule or polynucleotide.

In some embodiments, the binding molecule, e.g. TCR, or antigen binding portion thereof may be a recombinantly produced natural protein or mutated form thereof in which one or more property, such as binding characteristic, has been altered. In some aspects, the nucleic acid is synthetic. In some cases, the nucleic acid is or contains cDNA. In some aspects, the nucleic acid molecule can be modified for use in the constructs described herein, such as for codon optimization. In some cases, the sequences can be designed to contain terminal restriction site sequences for purposes of cloning into vectors.

In some embodiments, nucleic acid molecule encoding the binding molecule, e.g. TCR, can be obtained from a variety of sources, such as by polymerase chain reaction (PCR) amplification of encoding nucleic acids within or isolated from a given cell or cells. In some embodiments, the TCR is obtained from a biological source, such as from cells such as from a T cell (e.g. cytotoxic T cell), T cell hybridomas or other publicly available source. In some embodiments, a TCR may be derived from one of various animal species, such as human, mouse, rat, or other mammal, such as generally from a human. In some embodiments, the T cells can be obtained from in vivo isolated cells, such as from normal (or healthy) subjects or diseased subjects, including T cells present in peripheral blood mononuclear cells (PBMCs) or tumor-infiltrating lymphocytes (TILs). In some embodiments, the T cells can be a cultured T cell hybridoma or clone. For example, in some embodiments, to generate a vector encoding a TCR, the α and β chains can be PCR amplified from total cDNA isolated from a T cell clone expressing the TCR of interest and cloned into an expression vector. In some embodiments, the α and β chains can be synthetically generated. In some embodiments, the α and β chains are cloned into the same vector.

In some embodiments, the TCR or antigen-binding portion thereof can be synthetically generated from knowledge of the sequence of the TCR.

In some embodiments, the nucleic acid molecule contains a nucleic acid sequence encoding an alpha chain and/or a nucleotide sequence encoding a beta chain.

In some embodiments, the nucleic acid sequence encoding the alpha chain comprises one of the following: residues 61-816 of SEQ ID NO: 20, residues 58-804 of SEQ ID NO: 30, residues 61-825 of SEQ ID NO: 40, residues 64-813 of SEQ ID NO: 50, residues 64-816 of SEQ ID NO: 60, residues 58-807 of SEQ ID NO: 70, residues 61-825 of SEQ ID NO: 80, residues 67-831 of SEQ ID NO: 90, residues 58-801 of SEQ ID NO: 100, residues 64-810 of SEQ ID NO: 183, residues 58-801 of SEQ ID NO: 202, residues 67-813 of SEQ ID NO: 219, a degenerate sequence thereof or a sequence having at least 90%, 91%, 92%, 93%, 94%, 95%, 96%, 97%, 98%, 99% or more sequence identity thereto. In some aspects, the nucleotide sequence encoding the beta chain comprises one of the following: residues 58-936 of SEQ ID NO: 17, residues 58-930 of SEQ ID NO: 16, residues 58-939 of SEQ ID NO: 24, residues 64-930 of SEQ ID NO: 34 or 44, residues 58-933 of SEQ ID NO: 55, residues 58-927 of SEQ ID NO: 64, residues 64-936 of SEQ ID NO: 74, residues 58-933 of SEQ ID NO: 84, residues 63-930 of SEQ ID NO: 94, residues 46-936 of SEQ ID NO: 104, residues 58-933 of SEQ ID NO: 108, a degenerate sequence thereof or a sequence having at least 90%, 91%, 92%, 93%, 94%, 95%, 96%, 97%, 98%, 99% or more sequence identity thereto.

In some embodiments, the nucleotide sequence encoding the alpha chain and/or the nucleotide sequence encoding the beta chain is codon-optimized. Typically, codon optimization involves balancing the percentages of codons selected with the published abundance of human transfer RNAs so that none is overloaded or limiting. This may be necessary in some cases because most amino acids are encoded by more than one codon, and codon usage varies from organism to organism. Differences in codon usage between transfected genes and host cells can have effects on protein expression and immunogenicity of a nucleic acid construct. In general, for codon optimization, codons are chosen to select for those codons that are in balance with human usage frequency. Typically, the redundancy of the codons for amino acids is such that different codons code for one amino acid. In some embodiments, in selecting a codon for replacement, it may be desired that the resulting mutation is a silent mutation such that the codon change does not affect the amino acid sequence. Generally, the last nucleotide of the codon can remain unchanged without affecting the amino acid sequence.

In some cases, the nucleic acid sequence encoding the alpha chain contains one of the following: residues 67-825 of SEQ ID NO: 10, residues 58-813 of SEQ ID NO: 11, residues 64-822 of SEQ ID NO: 12 residues 61-825 of SEQ ID NO: 21, residues 58-813 of SEQ ID NO: 31, residues 61-834 of SEQ ID NO: 41, residues 63-822 of SEQ ID NO: 51, residues 64-825 of SEQ ID NO: 61, residues 58-816 of SEQ ID NO: 71, residues 61-834 of SEQ ID NO: 81, residues 67-840 of SEQ ID NO: 91, residues 58-810 of SEQ ID NO: 101, a degenerate sequence thereof or a sequence having at least 90%, 91%, 92%, 93%, 94%, 95%, 96%, 97%, 98%, 99% or more sequence identity thereto. In some examples, the nucleotide sequence encoding the beta chain contains one of the following: residues 58-930 of SEQ ID NO: 7, residues 58-936 of SEQ ID NO: 8, residues 58-933 of SEQ ID NO: 9 residues 58-939 of SEQ ID NO: 25, residues 64-930 of SEQ ID NO: 35, 45, or 95, residues 58-933 of SEQ ID NO: 54 or 85, residues 58-927 of SEQ ID NO: 65, residues 64-936 of SEQ ID NO: 75, residues 46-936 of SEQ ID NO: 105, a degenerate sequence thereof or a sequence having at least 90%, 91%, 92%, 93%, 94%, 95%, 96%, 97%, 98%, 99% or more sequence identity thereto.

In some embodiments, the nucleic acid molecule encoding an alpha chain and/or beta chain of a TCR comprises a nucleic acid sequence corresponding to a SEQ ID NO. set forth in Table 11. Also among the provided nucleic acid molecules encoding a TCR are those containing sequences at least at or about 90, 91, 92, 93, 94, 95, 96, 97, 98, or 99% identical to such sequences. Exemplary TCRs encoded by such sequences, or their modified versions, also are set forth in the Table 11.

TABLE 11

HPV16 E6 & E7 TCR Nucleotide SEQ ID NOs.

| Exemplary TCR or modified version thereof | Alpha | | Beta | |
|---|---|---|---|---|
| | Native | Codon-Optimized | Native | Codon-Optimized |
| TCR 3 | 20 | 21 | 24 | 25 |
| TCR 4 | 30 | 31 | 34 | 35 |
| TCR 5 | 40 | 41 | 44 | 45 |
| TCR 8 | 70 | 71 | 74 | 75 |
| TCR 9 | 80 | 81 | 84 | 85 |
| TCR 10 | 90 | 91 | 94 | 95 |
| TCR 6 | 50 | 51 | 54 | 55 |
| TCR 7 | 60 | 61 | 64 | 65 |
| TCR 11 | 100 | 101 | 104 | 105 |
| TCR 12 | 183 | 12 | 108 | 9 |
| TCR 13 | 202 | 11 | 17 | 8 |
| TCR 14 | 219 | 10 | 16 | 7 |
| TCR 15 | 389 | 1097 | 390 | 1098 |
| TCR 16 | 430 | 1099 | 431 | 1100 |
| TCR 17 | 1019 | 1101 | 1020 | 1102 |
| TCR 18 | 1021 | 1103 | 1022 | 1104 |
| TCR 19 | 1023 | 1105 | 1024 | 1106 |
| TCR 20 | 1025 | 1107 | 1026 | 1108 |
| TCR 21 | 1027 | 1109 | 1028 | 1110 |
| TCR 22 | 1029 | 1111 | 1030 | 1112 |
| TCR 23 | 1031 | 1113 | 1032 | 1114 |
| TCR 24 | 1033 | 1115 | 1034 | 1116 |
| TCR 25 | 1035 | 1117 | 1036 | 1118 |
| TCR 26 | 1037 | 1119 | 1038 | 1120 |
| TCR 27 | 1039 | 1121 | 1040 | 1122 |
| TCR 28 | 1041 | 1123 | 1042 | 1124 |
| TCR 29 | 1043 | 1125 | 1044 | 1126 |
| TCR 30 | 1045 | 1127 | 1046 | 1128 |
| TCR 31 | 1225 | 1129 | 1224 | 1130 |
| TCR 32 | 1049 | 1131 | 1050 | 1132 |
| TCR 33 | 1051 | 1133 | 1052 | 1134 |
| TCR 34 | 1226 | 1135 | 1227 | 1136 |
| TCR 35 | 1055 | 1137 | 1056 | 1138 |
| TCR 36 | 1057 | 1139 | 1058 | 1140 |
| TCR 37 | 1059 | 1141 | 1060 | 1142 |
| TCR 38 | 1061 | 1143 | 1062 | 1144 |
| TCR 39 | 1063 | 1145 | 1064 | 1146 |
| TCR 40 | 1065 | 1147 | 1066 | 1148 |
| TCR 41 | 1067 | 1149 | 1068 | 1150 |
| TCR 42 | 1069 | 1151 | 1070 | 1152 |
| TCR 43 | 1071 | 1153 | 1072 | 1154 |
| TCR 44 | 1073 | 1155 | 1074 | 1156 |
| TCR 45 | 1075 | 1157 | 1076 | 1158 |
| TCR 46 | 1077 | 1159 | 1078 | 1160 |
| TCR 47 | 1079 | 1161 | 1080 | 1162 |
| TCR 48 | 1081 | 1163 | 1082 | 1164 |
| TCR 49 | 1083 | 1165 | 1084 | 1166 |
| TCR 50 | 1085 | 1167 | 1086 | 1168 |
| TCR 51 | 1087 | 1169 | 1088 | 1170 |

TABLE 11-continued

HPV16 E6 & E7 TCR Nucleotide SEQ ID NOs.

| Exemplary TCR or modified version thereof | Alpha | | Beta | |
|---|---|---|---|---|
| | Native | Codon-Optimized | Native | Codon-Optimized |
| TCR 52 | 1089 | 1171 | 1090 | 1172 |
| TCR 53 | 1091 | 1173 | 1092 | 1174 |
| TCR 54 | 1093 | 1175 | 1094 | 1176 |
| TCR 55 | 1095 | 1177 | 1228 | 1178 |
| TCR 66 | | 1385 | | 1375 |

Also provided are vectors or constructs containing such nucleic acid molecules. In some embodiments, the vectors or constructs contain one or more promoters operatively linked to the nucleotide encoding the alpha chain and/or beta chain. In some embodiments, the promoter is operatively linked to one or more than one nucleic acid molecule.

In some embodiments, the vector or construct can contain a single promoter that drives the expression of one or more nucleic acid molecules. In some embodiments, such promoters can be multicistronic (bicistronic or tricistronic, see e.g., U.S. Pat. No. 6,060,273). For example, in some embodiments, transcription units can be engineered as a bicistronic unit containing an IRES (internal ribosome entry site), which allows coexpression of gene products (e.g. encoding an alpha chain and/or beta chain of a TCR) by a message from a single promoter. Alternatively, in some cases, a single promoter may direct expression of an RNA that contains, in a single open reading frame (ORF), two or three genes (e.g. encoding an alpha chain and/or beta chain of a TCR) separated from one another by sequences encoding a self-cleavage peptide (e.g., T2A) or a protease recognition site (e.g., furin). The ORF thus encodes a single polyprotein, which, either during (in the case of 2A e.g., T2A) or after translation, is cleaved into the individual proteins. In some cases, the peptide, such as T2A, can cause the ribosome to skip (ribosome skipping) synthesis of a peptide bond at the C-terminus of a 2A element, leading to separation between the end of the 2A sequence and the next peptide downstream (see, for example, de Felipe. *Genetic Vaccines and Ther.* 2:13 (2004) and deFelipe et al. *Traffic* 5:616-626 (2004)). Examples of 2A cleavage peptides, including those that can induce ribosome skipping, are Thosea asigna virus (T2A, e.g., SEQ ID NO: 211 or 274), porcine teschovirus-1 (P2A, e.g., SEQ ID NO: 204 or 345), equine rhinitis A virus (E2A, e.g., SEQ ID NO: 346) and 2A sequences from the foot-and-mouth disease virus (F2A, e.g., SEQ ID NO: 344) as described in U.S. Patent Publication No. 2007/0116690.

In some cases, the nucleotide sequence encoding the alpha chain and the nucleotide sequence encoding the beta chain are separated by a nucleotide sequence encoding an internal ribosome entry site (IRES) or a peptide sequence that causes ribosome skipping. In some instances, the nucleotide sequence encoding the alpha chain and the nucleotide sequence encoding the beta chain are separated by a peptide sequence that causes ribosome skipping. In some such instances, the peptide that causes ribosome skipping is a P2A or T2A peptide and/or contains the sequence of amino acids set forth in SEQ ID NO: 204, 211, 274 or 345. In some aspects, the nucleotide sequence encoding the peptide that causes ribosome skipping contains the sequence set forth in SEQ ID NO: 4, 5, 6, 207, 208, 209, or 210, 347, 1096, 1179, 1180, or 1181.

In some embodiments, the nucleic acid sequence encoding the alpha chain and the nucleotide sequence encoding the beta chain are present in any order, separated by the nucleotide sequence encoding an internal ribosome entry site (IRES) or a peptide sequence that causes ribosome skipping. For example, in some embodiments, the nucleic acid molecule comprises a nucleic acid sequence encoding a beta chain, a nucleic acid sequence encoding an IRES or peptide sequence that causes ribosome skipping, e.g., a P2A or T2A sequence as described herein, and a nucleic acid sequence that encodes an alpha chain, in that order. In other embodiments, the nucleic acid molecule contains a nucleic acid sequence that encodes an alpha chain, a nucleic acid sequence that encodes an IRES or peptide sequence that causes ribosome skipping, and a nucleic acid sequence that encodes a beta chain, in that order.

Thus, in some aspects, the nucleic acid molecule encodes a polypeptide comprising a beta chain, an IRES or peptide that causes ribosome skipping, and an alpha chain, in that order. In other aspects, the nucleic acid molecule encodes a polypeptide comprising an alpha chain, an IRES or peptide that causes ribosome skipping, and a beta chain, in that order.

In some embodiments, the nucleic acid molecule encodes a polypeptide containing an amino acid sequence set forth in Table 12, or a sequence having at least 90%, 91%, 92%, 93%, 94%, 95%, 96%, 97%, 98%, or 99% sequence identity thereto. In some embodiments, the nucleic acid molecule encodes a polypeptide set forth in any of SEQ ID NOS: 1, 2, 3, 27, 37, 47, 57, 67, 77, 87, 97, 107, 223, 224, 225, 226, 227, 228, 229, 230, 231, 340-342, 350-388, 391-429, or 1383-1384, or a sequence having at least 90%, 91%, 92%, 93%, 94%, 95%, 96%, 97%, 98%, or 99% sequence identity thereto. In some embodiments, the nucleic acid molecule comprises the nucleic acid sequence set forth in any of SEQ ID NOs: 13, 14, 15, 26, 36, 46, 56, 66, 76, 86, 96, 106, 432-472, or 1382, or a sequence having at least 90%, 91%, 92%, 93%, 94%, 95%, 96%, 97%, 98%, or 99% sequence identity thereto.

Also provided are polypeptides containing a sequence encoded by any of the provided nucleic acids. In some aspects, the polypeptide comprises an amino acid sequence corresponding to a SEQ ID NO. shown in Table 12, or a sequence having at least 90%, 91%, 92%, 93%, 94%, 95%, 96%, 97%, 98%, or 99% sequence identity thereto. In some embodiments, the polypeptide comprises the sequence set forth in any of SEQ ID NOS 1, 2, 3, 27, 37, 47, 57, 67, 77, 87, 97, 107, 223, 224, 225, 226, 227, 228, 229, 230, 231, 340-342, 350-388, or 391-429, or 1383-1384, or a sequence having at least 90%, 91%, 92%, 93%, 94%, 95%, 96%, 97%, 98%, or 99% sequence identity thereto. Exemplary of such TCRs, or their modified versions, also are set forth in the Table 12.

TABLE 12

HPV16 E6 & E7 TCR SEQ ID NOs.

| Exemplary TCR or modified version | Full Encoded Amino Acid | | Full Nucleotide Codon-Optimized |
|---|---|---|---|
| | Native | Modified | |
| TCR 3 | 223 | 27 | 26 |
| TCR 4 | 224 | 37 | 36 |
| TCR 5 | 225 | 47 | 46 |
| TCR 8 | 228 | 77 | 76 |
| TCR 9 | 229 | 87 | 86 |
| TCR 10 | 230 | 97 | 96 |
| TCR 6 | 226 | 57 | 56 |
| TCR 7 | 227 | 67 | 66 |
| TCR 11 | 231 | 107 | 106 |
| TCR 12 | 340 | 3 | 15 |
| TCR 13 | 341 | 2 | 14 |
| TCR 14 | 342 | 1 | 13 |
| TCR 15 | 391 | 350 | 432 |
| TCR 16 | 392 | 351 | 433 |
| TCR 17 | 393 | 352 | 434 |
| TCR 18 | 394 | 353 | 435 |
| TCR 19 | 395 | 354 | 436 |
| TCR 20 | 396 | 355 | 437 |
| TCR 21 | 397 | 356 | 438 |
| TCR 22 | 398 | 357 | 439 |
| TCR 23 | 399 | 358 | 440 |
| TCR 24 | 400 | 359 | 441 |
| TCR 25 | 401 | 360 | 442 |
| TCR 26 | 402 | 361 | 443 |
| TCR 27 | 403 | 362 | 444 |
| TCR 28 | 404 | 363 | 445 |
| TCR 29 | 405 | 364 | 446 |
| TCR 30 | 406 | 365 | 447 |
| TCR 31 | 407 | 366 | 448 |
| TCR 32 | 408 | 367 | 449 |
| TCR 33 | 409 | 368 | 450 |
| TCR 34 | 410 | 369 | 451 |
| TCR 35 | 411 | 370 | 452 |
| TCR 36 | 412 | 371 | 453 |
| TCR 37 | 413 | 372 | 454 |
| TCR 38 | 414 | 373 | 455 |
| TCR 39 | 415 | 374 | 456 |
| TCR 40 | 416 | 375 | 457 |
| TCR 41 | 417 | 376 | 458 |
| TCR 42 | 418 | 377 | 459 |
| TCR 43 | 419 | 378 | 460 |
| TCR 44 | 420 | 379 | 461 |
| TCR 45 | 421 | 380 | 462 |
| TCR 46 | 422 | 381 | 463 |
| TCR 47 | 423 | 382 | 464 |
| TCR 48 | 424 | 383 | 465 |
| TCR 49 | 425 | 384 | 466 |
| TCR 50 | 426 | 385 | 467 |
| TCR 51 | 427 | 386 | 468 |
| TCR 52 | 428 | 387 | 469 |
| TCR 53 | 429 | 388 | 470 |
| TCR 54 | 227 | 67 | 471 |
| TCR 55 | 340 | 3 | 472 |
| TCR 66 | 1383 | 1384 | 1382 |

In some embodiments, the nucleic acid molecule may further encode a marker (e.g. EGFRt or other marker as described) that is separated from the CAR or separated from the TCR chains by a linker, such as a cleavable linker sequence or a peptide sequence that causes ribosome skipping, e.g., T2A or P2A.

In some embodiments, the construct can be arranged in any order so that the encoding marker sequence is either 3′ to the alpha and/or beta sequence, 5′ to the alpha and/or beta sequence and/or between the alpha and beta sequence, where, in some cases, each separate component is separated by a cleavable linker sequence or a peptide that causes ribosome skipping (e.g. T2A or P2A) or an IRES. In some embodiments, the nucleic acid molecule contains a nucleic acid sequence that encodes a marker (e.g., EGFRt), cleavable linker or ribosome skip sequence (e.g. T2A or P2A), beta chain, cleavable linker or ribosome skip sequence (e.g.

T2A or P2A), and alpha chain, in that order. In some embodiments, the nucleic acid molecule contains a nucleic acid sequence that encodes a marker (e.g., EGFRt), cleavable linker or ribosome skip sequence (e.g., T2A or P2A), alpha chain, cleavable linker or ribosome skip sequence (e.g., T2A or P2A), and beta chain, in that order. In some embodiments, the nucleic acid molecule contains a nucleic acid sequence that encodes a beta chain, cleavable linker or ribosome skip sequence (e.g., T2A or P2A), an alpha chain, a cleavable linker or ribosome skip sequence (e.g., T2A or P2A) and a marker (e.g. EGFRt), in that order. In some embodiments, the nucleic acid molecule contains a nucleic acid sequence that encodes an alpha chain, cleavable linker or ribosome skip sequence (e.g. T2A or P2A), a beta chain, a cleavable linker or ribosome skip sequence (e.g., T2A or P2A) and a marker (e.g., EGFRt), in that order. In some embodiments, the nucleic acid molecule contains a nucleic acid sequence that encodes an alpha chain, cleavable linker or ribosome skip sequence (e.g., T2A or P2A), a marker (e.g., EGFRt), a cleavable linker or ribosome skip sequence (e.g., T2A or P2A) and a beta chain, in that order. In some embodiments, the nucleic acid molecule contains a nucleic acid sequence that encodes a beta chain, cleavable linker or ribosome skip sequence (e.g., T2A or P2A), a marker (e.g. EGFRt), a cleavable linker or ribosome skip sequence (e.g., T2A or P2A) and a alpha chain, in that order.

In some embodiments, introduction of a construct encoding the CAR and EGFRt separated by a T2A ribosome switch can express two proteins from the same construct, such that the EGFRt can be used as a marker to detect cells expressing such construct.

The nucleic acid may encode an amino acid sequence comprising the variable alpha (Vα) region or variable light (VL) region of the TCR or antibody, respectively. In some cases, the nucleic acid encodes an amino acid sequence comprising the variable beta (Vβ) region or variable heavy (VH) region of the TCR or antibody, respectively. In a further embodiment, one or more vectors (e.g., expression vectors) comprising such nucleic acid are provided.

Also provided are vectors, such as those containing any of the nucleic acids described herein. In some embodiments, nucleic acid or nucleic acids encoding one or both chains of a binding molecule, e.g., TCR, are cloned into a suitable expression vector or vectors. The expression vector can be any suitable recombinant expression vector, and can be used to transform or transfect any suitable host. Suitable vectors include those designed for propagation and expansion or for expression or both, such as plasmids and viruses. In some embodiments, the vector is an expression vector.

In some embodiments, the vector can a vector of the pUC series (Fermentas Life Sciences), the pBluescript series (Stratagene, LaJolla, Calif.), the pET series (Novagen, Madison, Wis.), the pGEX series (Pharmacia Biotech, Uppsala, Sweden), or the pEX series (Clontech, Palo Alto, Calif.). In some cases, bacteriophage vectors, such as λG10, λGT11, λZapII (Stratagene), λEMBL4, and λNM1149, also can be used. In some embodiments, plant expression vectors can be used and include pBI01, pBI101.2, pBI101.3, pBI121 and pBIN19 (Clontech). In some embodiments, animal expression vectors include pEUK-C1, pMAM and pMAM-neo (Clontech). In some cases, the vector is a viral vector. In some such aspects, the viral vector is a retroviral vector, such as a lentiviral vector. In some instances, the lentiviral vector is derived from HIV-1.

In some embodiments, the recombinant expression vectors can be prepared using standard recombinant DNA techniques. In some embodiments, vectors can contain regulatory sequences, such as transcription and translation initiation and termination codons, which are specific to the type of host (e.g., bacterium, fungus, plant, or animal) into which the vector is to be introduced, as appropriate and taking into consideration whether the vector is DNA- or RNA-based. In some embodiments, the vector can contain a nonnative promoter operably linked to the nucleotide sequence encoding the binding molecule, such as TCR, antibody or antigen-binding fragment thereof. In some embodiments, the promoter can be a non-viral promoter or a viral promoter, such as a cytomegalovirus (CMV) promoter, an SV40 promoter, an RSV promoter, and a promoter found in the long-terminal repeat of the murine stem cell virus. Other promoters known to a skilled artisan also are contemplated.

Also provided are methods of making the binding molecules (including antigen-binding fragments). In some embodiments, a host cell comprising such nucleic acid is provided. For recombinant production of the binding molecules, nucleic acid encoding the binding molecule, e.g., as described above, may be isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the alpha and beta chains of the TCR or the heavy and light chains of the antibody). In some embodiments, a method of making the binding molecule is provided, wherein the method comprises culturing a host cell comprising a nucleic acid encoding the binding molecule, as provided above, under conditions suitable for expression of the binding molecule, and optionally recovering the binding molecule from the host cell (or host cell culture medium).

In one such embodiment, a host cell comprises (e.g., has been transformed with): a vector comprising a nucleic acid that encodes an amino acid sequence comprising the Vβ region of the TCR or antigen-binding fragment thereof and a nucleic acid that encodes an amino acid sequence comprising the Vα region of the TCR or antigen-binding fragment thereof. In another such embodiment, a host cell comprises (e.g. has been transformed with): a vector comprising a nucleic acid that encodes an amino acid sequence comprising the $V_H$ of the antibody or antigen-binding fragment thereof and the $V_L$ of the antibody or antigen-binding fragment thereof. In some aspects, a host cell comprises (e.g., has been transformed with): a first vector comprising a nucleic acid that encodes an amino acid sequence comprising the Vα region of the TCR or antigen-binding fragment thereof and a second vector comprising a nucleic acid that encodes an amino acid sequence comprising the Vβ region of the TCR or antigen-binding fragment thereof. In other aspects, a host cell comprises (e.g. has been transformed with): a first vector comprising a nucleic acid that encodes an amino acid sequence or comprising the $V_L$ of the antibody or antigen-binding fragment thereof and a second vector comprising a nucleic acid that encodes an amino acid sequence comprising the $V_H$ of the antibody or antigen-binding fragment thereof.

In addition to prokaryotes, eukaryotic microbes such as filamentous fungi or yeast are suitable cloning or expression hosts for binding molecule-encoding vectors, including fungi and yeast strains whose glycosylation pathways have been modified to mimic or approximate those in human cells. See Gerngross, Nat. Biotech. 22:1409-1414 (2004), and Li et al., Nat. Biotech. 24:210-215 (2006).

Exemplary eukaryotic cells that may be used to express polypeptides include, but are not limited to, COS cells, including COS 7 cells; 293 cells, including 293-6E cells; CHO cells, including CHO-S, DG44. Lec13 CHO cells, and FUT8 CHO cells; PER.C6® cells; and NSO cells. In some embodiments, a particular eukaryotic host cell is selected based on its ability to make desired post-translational modifications to the binding molecule. For example, in some embodiments, CHO cells produce polypeptides that have a higher level of sialylation than the same polypeptide produced in 293 cells. In some embodiments, the binding molecule is produced in a cell-free system. Exemplary cell-free systems are described, e.g., in Sitaraman et al., *Methods Mol. Biol.* 498: 229-44 (2009); Spirin, *Trends Biotechnol.* 22: 538-45 (2004); Endo et al., *Biotechnol. Adv.* 21: 695-713 (2003).

III. Methods for Identifying and Generating T Cell Receptors

In some embodiments, provided are methods for identifying and generating T cell receptors directed towards a target antigen. In some aspects, the methods involve subjecting biological samples containing T cells, such as primary T cells, including those derived from normal donors or patients having a disease or condition of interest, to multiple rounds of antigen exposure and assessment. In some aspects, the rounds involve the use of artificial or engineered antigen presenting cells, such as autologous dendritic cells or other APCs pulsed with a desired peptide antigen, to promote presentation on an MHC, such as a class I or II MHC. In some aspects, multiple rounds of antigen exposure are carried out and in some aspects T cells are sorted following one or more of the rounds, e.g., based on ability to bind to the desired antigen (such as peptide-MHC tetramers). In some aspects sorting is carried out by flow cytometry. In some aspects, cells from cells deemed to bind to the desired antigen (positive fraction) and cells deemed not to bind to the antigen, are assessed, e.g., by single-cell sequencing methods. In some aspects, the methods sequence and identify, at a single-cell level, TCR pairs present in each sample. In some aspects, the methods can quantify the number of copies of a given TCR pair present in a sample, and as such can assess the abundance of a given TCR in a given sample, and/or enrichment thereof over another sample, such as enrichment or abundance in the positive (antigen-binding) fraction, e.g., over one or more rounds, for example, as compared to the negative fraction. In some aspects, such assays are performed to generate antigen-specific T cell receptors (TCRs) that specifically bind to human papillomavirus 16 or 18 peptide antigens such as peptides derived from E6 or E7, such as E6(29-38) or E7(11-19) peptide, e.g., presented on MHC-I molecules and survived and/or were enriched over time, following multiple rounds of antigen-stimulation. In some aspects, clonal T cell lines are generated and the sequences of individual paired TCR alpha and beta chains and abundance thereof in various populations were determined on a single-cell basis, using high-throughput paired TCR sequencing.

In some aspects, peptide-pulsed HLA:A02:01APCs were generated with HPV 16 E6(29-38) peptide (TIHDIILECV; SEQ ID NO:233) or E7(11-19) peptide (YMLDLQPET; SEQ ID NO:236). Autologous CD8+ T cells from normal human donors are incubated over multiple rounds with the peptide-pulsed cells, and selections were carried out based on binding to peptide-loaded autologous MHC tetramers.

In some aspects, cells were subjected to multiple, such as a total of two or three or more, rounds of stimulation, in the presence of peptide-pulsed cells (such as with a particular peptide concentration of 1000 ng/mL maintained over the three rounds). Following one or more of, such as following the first and/or following the second and third rounds of stimulation, cells were sorted by flow cytometry into populations positive and negative, respectively, for binding to peptide-MHC tetramers containing the appropriate tetramer. Cells of the tetramer-positive and negative populations following each or one or more of the one or more, such as the second and third, rounds in some aspects are subjected to single-cell TCR sequencing, to assess the presence and frequency of individual TCRs in the different populations, and the persistence of TCR clones over multiple rounds of antigen stimulation.

In some aspects, cell populations from the positive and negative fractions (i.e., sorted by flow cytometry based on positive and negative staining, respectively, for binding to the relevant antigen such as peptide-MHC such as loaded tetramers, e.g., as determined by flow cytometry), following the one or more rounds, are subject to high-throughput single-cell sequencing for TCR alpha and beta chain pairs. High throughput single cell TCR sequencing in some aspects is performed as generally described in published PCT patent applications, publication numbers WO2012/048340, WO2012/048341 and WO2016/044227. The sequencing methods thus in some aspects employ single-cell droplets and sample and molecular barcodes, to identify individual pairs of TCR alpha and beta chain sequences at a single-cell level, for each of a large number (e.g., millions) of single cells present in a single starting composition, and to assess abundance of each TCR pair in various populations assessed. The ability to identify and quantify TCR pairs at a single-cell level in some embodiments permits the assessment of the frequency of each of various TCR pairs in each of the individual positive and negative fractions, and to assess enrichment and persistence of TCRs over multiple rounds of antigen stimulation.

In some aspects, the methods generate, identify, isolate and/or select TCR pairs that are enriched in antigen-binding, e.g., peptide-binding, fractions following at least one and in some aspects a plurality of, multiple rounds of stimulation. In some aspects, the TCRs are present in and/or present at a desired abundance in and/or preferentially enriched following, rounds 1, 2 and/or and 3 and in some aspects at least multiple rounds, of antigen exposure. In some aspects, the TCRs are enriched in the population over time following multiple rounds of exposure to antigen. Also provided are TCRs generated or identified using such methods, such as TCRs having such properties, such as the ability to survive and/or expand over multiple rounds of antigen exposure, such as in a peptide-pulsed APC assay.

IV. Engineered Cells

Also provided are cells such as cells that have been engineered to contain the binding molecule described herein. Also provided are populations of such cells, compositions containing such cells and/or enriched for such cells, such as in which cells expressing the binding molecule make up at least 15%, 20%, 25%, 30%, 35%, 40%, 50%, 60%, 70%, 80%, 90%, 91%, 92%, 93%, 94%, 95%, 96%, 97%, 98%, 99%, or more percent of the total cells in the composition or cells of a certain type such as T cells or CD8+ or CD4+ cells. In some embodiments, the cells are primary T cells. Among the compositions are pharmaceutical compositions and formulations for administration, such as for adoptive cell therapy. Also provided are therapeutic methods for administering the cells and compositions to subjects, e.g., patients.

Thus also provided are genetically engineered cells expressing the binding molecules. The cells generally are eukaryotic cells, such as mammalian cells, and typically are human cells. In some embodiments, the cells are derived from the blood, bone marrow, lymph, or lymphoid organs, are cells of the immune system, such as cells of the innate or adaptive immunity, e.g., myeloid or lymphoid cells, including lymphocytes, typically T cells and/or NK cells. Other exemplary cells include stem cells, such as multipotent and pluripotent stem cells, including induced pluripotent stem cells (iPSCs). The cells typically are primary cells, such as those isolated directly from a subject and/or isolated from a subject and frozen. In some embodiments, the cells include one or more subsets of T cells or other cell types, such as whole T cell populations, CD4+ cells, CD8+ cells, and subpopulations thereof, such as those defined by function, activation state, maturity, potential for differentiation, expansion, recirculation, localization, and/or persistence capacities, antigen-specificity, type of antigen receptor, presence in a particular organ or compartment, marker or cytokine secretion profile, and/or degree of differentiation. With reference to the subject to be treated, the cells may be allogeneic and/or autologous. Among the methods include off-the-shelf methods. In some aspects, such as for off-the-shelf technologies, the cells are pluripotent and/or multipotent, such as stem cells, such as induced pluripotent stem cells (iPSCs). In some embodiments, the methods include isolating cells from the subject, preparing, processing, culturing, and/or engineering them, as described herein, and re-introducing them into the same patient, before or after cryopreservation.

Among the sub-types and subpopulations of T cells and/or of CD4+ and/or of CD8+ T cells are naïve T ($T_N$) cells, effector T cells ($T_{EFF}$), memory T cells and sub-types thereof, such as stem cell memory T ($T_{SCM}$), central memory T ($T_{CM}$), effector memory T ($T_{EM}$), or terminally differentiated effector memory T cells, tumor-infiltrating lymphocytes (TIL), immature T cells, mature T cells, helper T cells, cytotoxic T cells, mucosa-associated invariant T (MAIT) cells, naturally occurring and adaptive regulatory T (Treg) cells, helper T cells, such as TH1 cells, TH2 cells, TH3 cells, TH17 cells, TH9 cells, TH22 cells, follicular helper T cells, alpha/beta T cells, and delta/gamma T cells.

In some embodiments, the cells are natural killer (NK) cells. In some embodiments, the cells are monocytes or granulocytes, e.g., myeloid cells, macrophages, neutrophils, dendritic cells, mast cells, eosinophils, and/or basophils.

In some embodiments, the cells include one or more nucleic acids introduced via genetic engineering, and thereby express recombinant or genetically engineered products of such nucleic acids. In some embodiments, the nucleic acids are heterologous, i.e., normally not present in a cell or sample obtained from the cell, such as one obtained from another organism or cell, which for example, is not ordinarily found in the cell being engineered and/or an organism from which such cell is derived. In some embodiments, the nucleic acids are not naturally occurring, such as a nucleic acid not found in nature, including one comprising chimeric combinations of nucleic acids encoding various domains from multiple different cell types.

In some embodiments, genes and/or gene products (and/or expression thereof) in the provided cells, and/or compositions containing such cells, are reduced, deleted, eliminated, knocked-out or disrupted. Such genes and/or gene products in some aspects include one or more of the gene encoding (or product thereof) TCR alpha constant region (TRAC) and/or TCR beta constant region (TRBC; encoded in humans by TRBC1 or TRBC2), e.g., to reduce or prevent expression of the endogenous TCR in the cell, e.g. T cell, and/or α chain thereof. In some embodiments, the genes and/or gene products, such as TRAC and/or TRBC, is reduced, deleted, eliminated, knocked-out or disrupted in any of the engineered cells provided herein and/or in any of the methods for producing engineered cells provided herein. In some embodiments, engineered cells and/or engineered cells produced by the methods are cells that have been engineered to express the binding molecule described herein, populations of such cells, compositions containing such cells and/or enriched for such cells. In some embodiments, genes and/or gene products, such as the TRAC and/or TRBC, is reduced, deleted, eliminated, knocked-out or disrupted in primary T cells, to reduce, delete, eliminate, knock-out or disrupt the expression of the endogenous TCR in primary T cells, e.g., that are engineered to express any of the binding molecules, e.g., TCRs, described herein.

In some embodiments, the reduction, deletion, elimination, knock-out or disruption of the endogenous genes encoding the TCR or α chain, a domain and/or a region thereof is carried out, e.g., by any methods or processes described herein, e.g., in Section V below.

A. Preparation of Cells for Genetic Engineering

In some embodiments, preparation of the engineered cells includes one or more culture and/or preparation steps. The cells for introduction of the binding molecule, e.g., TCR or CAR, may be isolated from a sample, such as a biological sample, e.g., one obtained from or derived from a subject. In some embodiments, the subject from which the cell is isolated is one having the disease or condition or in need of a cell therapy or to which cell therapy will be administered. The subject in some embodiments is a human in need of a particular therapeutic intervention, such as the adoptive cell therapy for which cells are being isolated, processed, and/or engineered.

Accordingly, the cells in some embodiments are primary cells, e.g., primary human cells. The samples include tissue, fluid, and other samples taken directly from the subject, as well as samples resulting from one or more processing steps, such as separation, centrifugation, genetic engineering (e.g. transduction with viral vector), washing, and/or incubation. The biological sample can be a sample obtained directly from a biological source or a sample that is processed. Biological samples include, but are not limited to, body fluids, such as blood, plasma, serum, cerebrospinal fluid, synovial fluid, urine and sweat, tissue and organ samples, including processed samples derived therefrom.

In some aspects, the sample from which the cells are derived or isolated is blood or a blood-derived sample, or is or is derived from an apheresis or leukapheresis product. Exemplary samples include whole blood, peripheral blood mononuclear cells (PBMCs), leukocytes, bone marrow, thymus, tissue biopsy, tumor, leukemia, lymphoma, lymph node, gut associated lymphoid tissue, mucosa associated lymphoid tissue, spleen, other lymphoid tissues, liver, lung, stomach, intestine, colon, kidney, pancreas, breast, bone, prostate, cervix, testes, ovaries, tonsil, or other organ, and/or cells derived therefrom. Samples include, in the context of cell therapy, e.g., adoptive cell therapy, samples from autologous and allogeneic sources.

In some embodiments, the cells are derived from cell lines, e.g., T cell lines. The cells in some embodiments are obtained from a xenogeneic source, for example, from mouse, rat, non-human primate, or pig.

In some embodiments, isolation of the cells includes one or more preparation and/or non-affinity based cell separation steps. In some examples, cells are washed, centrifuged, and/or incubated in the presence of one or more reagents, for example, to remove unwanted components, enrich for desired components, lyse or remove cells sensitive to particular reagents. In some examples, cells are separated based on one or more property, such as density, adherent properties, size, sensitivity and/or resistance to particular components.

In some examples, cells from the circulating blood of a subject are obtained, e.g., by apheresis or leukapheresis. The samples, in some aspects, contain lymphocytes, including T cells, monocytes, granulocytes, B cells, other nucleated white blood cells, red blood cells, and/or platelets, and in some aspects contain cells other than red blood cells and platelets.

In some embodiments, the blood cells collected from the subject are washed, e.g., to remove the plasma fraction and to place the cells in an appropriate buffer or media for subsequent processing steps. In some embodiments, the cells are washed with phosphate buffered saline (PBS). In some embodiments, the wash solution lacks calcium and/or magnesium and/or many or all divalent cations. In some aspects, a washing step is accomplished a semi-automated "flow-through" centrifuge (for example, the Cobe 2991 cell processor, Baxter) according to the manufacturer's instructions. In some aspects, a washing step is accomplished by tangential flow filtration (TFF) according to the manufacturer's instructions. In some embodiments, the cells are resuspended in a variety of biocompatible buffers after washing, such as, for example, $Ca^{++}/Mg^{++}$ free PBS. In certain embodiments, components of a blood cell sample are removed and the cells directly resuspended in culture media.

In some embodiments, the methods include density-based cell separation methods, such as the preparation of white blood cells from peripheral blood by lysing the red blood cells and centrifugation through a Percoll or Ficoll gradient.

In some embodiments, the isolation methods include the separation of different cell types based on the expression or presence in the cell of one or more specific molecules, such as surface markers, e.g., surface proteins, intracellular markers, or nucleic acid. In some embodiments, any known method for separation based on such markers may be used. In some embodiments, the separation is affinity- or immunoaffinity-based separation. For example, the isolation in some aspects includes separation of cells and cell populations based on the cells' expression or expression level of one or more markers, typically cell surface markers, for example, by incubation with an antibody or binding partner that specifically binds to such markers, followed generally by washing steps and separation of cells having bound the antibody or binding partner, from those cells having not bound to the antibody or binding partner.

Such separation steps can be based on positive selection, in which the cells having bound the reagents are retained for further use, and/or negative selection, in which the cells having not bound to the antibody or binding partner are retained. In some examples, both fractions are retained for further use. In some aspects, negative selection can be particularly useful where no antibody is available that specifically identifies a cell type in a heterogeneous population, such that separation is best carried out based on markers expressed by cells other than the desired population.

The separation need not result in 100% enrichment or removal of a particular cell population or cells expressing a particular marker. For example, positive selection of or enrichment for cells of a particular type, such as those expressing a marker, refers to increasing the number or percentage of such cells, but need not result in a complete absence of cells not expressing the marker. Likewise, negative selection, removal, or depletion of cells of a particular type, such as those expressing a marker, refers to decreasing the number or percentage of such cells, but need not result in a complete removal of all such cells.

In some examples, multiple rounds of separation steps are carried out, where the positively or negatively selected fraction from one step is subjected to another separation step, such as a subsequent positive or negative selection. In some examples, a single separation step can deplete cells expressing multiple markers simultaneously, such as by incubating cells with a plurality of antibodies or binding partners, each specific for a marker targeted for negative selection. Likewise, multiple cell types can simultaneously be positively selected by incubating cells with a plurality of antibodies or binding partners expressed on the various cell types.

For example, in some aspects, specific subpopulations of T cells, such as cells positive or expressing high levels of one or more surface markers, e.g., $CD28^+$, $CD62L^+$, $CCR7^+$, $CD27^+$, $CD127^+$, $CD4^+$, $CD8^+$, $CD45RA^+$, and/or $CD45RO^+$ T cells, are isolated by positive or negative selection techniques.

For example, CD3+, $CD28^+$ T cells can be positively selected using anti-CD3/anti-CD28 conjugated magnetic beads (e.g., DYNABEADS® M-450 CD3/CD28 T Cell Expander).

In some embodiments, isolation is carried out by enrichment for a particular cell population by positive selection, or depletion of a particular cell population, by negative selection. In some embodiments, positive or negative selection is accomplished by incubating cells with one or more antibodies or other binding agent that specifically bind to one or more surface markers expressed or expressed (marker$^+$) at a relatively higher level (marker$^{high}$) on the positively or negatively selected cells, respectively.

In some embodiments, T cells are separated from a PBMC sample by negative selection of markers expressed on non-T cells, such as B cells, monocytes, or other white blood cells, such as CD14. In some aspects, a $CD4^+$ or $CD8^+$ selection step is used to separate $CD4^+$ helper and $CD8^+$ cytotoxic T cells. Such $CD4^+$ and $CD8^+$ populations can be further sorted into sub-populations by positive or negative selection for markers expressed or expressed to a relatively higher degree on one or more naive, memory, and/or effector T cell subpopulations.

In some embodiments, CD8+ cells are further enriched for or depleted of naive, central memory, effector memory, and/or central memory stem cells, such as by positive or negative selection based on surface antigens associated with the respective subpopulation. In some embodiments, enrichment for central memory T ($T^{CM}$) cells is carried out to increase efficacy, such as to improve long-term survival, expansion, and/or engraftment following administration, which in some aspects is particularly robust in such subpopulations. See Terakura et al. (2012) Blood. 1:72-82; Wang et al. (2012) J Immunother. 35(9):689-701. In some embodiments, combining $T_{CM}$-enriched CD8+ T cells and $CD4^+$ T cells further enhances efficacy.

In embodiments, memory T cells are present in both $CD62L^+$ and $CD62L^-$ subsets of $CD8^+$ peripheral blood lymphocytes. PBMC can be enriched for or depleted of $CD62L^-CD8^+$ and/or $CD62L^+ CD8^+$ fractions, such as using anti-CD8 and anti-CD62L antibodies.

In some embodiments, the enrichment for central memory T ($T_{CM}$) cells is based on positive or high surface expression of CD45RO, CD62L, CCR7, CD28, CD3, and/or CD 127; in some aspects, it is based on negative selection for cells expressing or highly expressing CD45RA and/or granzyme B. In some aspects, isolation of a $CD8^+$ population enriched for $T_{CM}$ cells is carried out by depletion of cells expressing CD4, CD14, CD45RA, and positive selection or enrichment for cells expressing CD62L. In one aspect, enrichment for central memory T ($T_{CM}$) cells is carried out starting with a negative fraction of cells selected based on CD4 expression, which is subjected to a negative selection based on expression of CD14 and CD45RA, and a positive selection based on CD62L. Such selections in some aspects are carried out simultaneously and in other aspects are carried out sequentially, in either order. In some aspects, the same CD4 expression-based selection step used in preparing the $CD8^+$ cell population or subpopulation, also is used to generate the $CD4^+$ cell population or sub-population, such that both the positive and negative fractions from the CD4-based separation are retained and used in subsequent steps of the methods, optionally following one or more further positive or negative selection steps.

In a particular example, a sample of PBMCs or other white blood cell sample is subjected to selection of $CD4^+$ cells, where both the negative and positive fractions are retained. The negative fraction then is subjected to negative selection based on expression of CD14 and CD45RA, and positive selection based on a marker characteristic of central memory T cells, such as CD62L or CCR7, where the positive and negative selections are carried out in either order.

CD4+ T helper cells are sorted into naïve, central memory, and effector cells by identifying cell populations that have cell surface antigens. $CD4^+$ lymphocytes can be obtained by standard methods. In some embodiments, naive $CD4^+$ T lymphocytes are $CD45RO^-$, $CD45RA^+$, $CD62L^+$, $CD4^+$ T cells. In some embodiments, central memory $CD4^+$ cells are $CD62L^+$ and $CD45RO^+$. In some embodiments, effector $CD4^+$ cells are $CD62L^-$ and $CD45RO^-$.

In one example, to enrich for $CD4^+$ cells by negative selection, a monoclonal antibody cocktail typically includes antibodies to CD14, CD20, CD11b, CD16, HLA-DR, and CD8. In some embodiments, the antibody or binding partner is bound to a solid support or matrix, such as a magnetic bead or paramagnetic bead, to allow for separation of cells for positive and/or negative selection. For example, in some embodiments, the cells and cell populations are separated or isolated using immunomagnetic (or affinity magnetic) separation techniques (reviewed in Methods in Molecular Medicine, vol. 58: Metastasis Research Protocols, Vol. 2: Cell Behavior In Vitro and In Vivo, p 17-25 Edited by: S. A. Brooks and U. Schumacher© Humana Press Inc., Totowa, N.J.).

In some aspects, the sample or composition of cells to be separated is incubated with small, magnetizable or magnetically responsive material, such as magnetically responsive particles or microparticles, such as paramagnetic beads (e.g., such as Dynabeads or MACS beads). The magnetically responsive material, e.g., particle, generally is directly or indirectly attached to a binding partner, e.g., an antibody, that specifically binds to a molecule, e.g., surface marker, present on the cell, cells, or population of cells that it is desired to separate, e.g., that it is desired to negatively or positively select.

In some embodiments, the magnetic particle or bead comprises a magnetically responsive material bound to a specific binding member, such as an antibody or other binding partner. There are many well-known magnetically responsive materials used in magnetic separation methods. Suitable magnetic particles include those described in Molday, U.S. Pat. No. 4,452,773, and in European Patent Specification EP 452342 B, which are hereby incorporated by reference. Colloidal sized particles, such as those described in Owen U.S. Pat. No. 4,795,698, and Liberti et al., U.S. Pat. No. 5,200,084 are other examples.

The incubation generally is carried out under conditions whereby the antibodies or binding partners, or molecules, such as secondary antibodies or other reagents, which specifically bind to such antibodies or binding partners, which are attached to the magnetic particle or bead, specifically bind to cell surface molecules if present on cells within the sample.

In some aspects, the sample is placed in a magnetic field, and those cells having magnetically responsive or magnetizable particles attached thereto will be attracted to the magnet and separated from the unlabeled cells. For positive selection, cells that are attracted to the magnet are retained; for negative selection, cells that are not attracted (unlabeled cells) are retained. In some aspects, a combination of positive and negative selection is performed during the same selection step, where the positive and negative fractions are retained and further processed or subject to further separation steps.

In certain embodiments, the magnetically responsive particles are coated in primary antibodies or other binding partners, secondary antibodies, lectins, enzymes, or streptavidin. In certain embodiments, the magnetic particles are attached to cells via a coating of primary antibodies specific for one or more markers. In certain embodiments, the cells, rather than the beads, are labeled with a primary antibody or binding partner, and then cell-type specific secondary antibody- or other binding partner (e.g., streptavidin)-coated magnetic particles, are added. In certain embodiments, streptavidin-coated magnetic particles are used in conjunction with biotinylated primary or secondary antibodies.

In some embodiments, the magnetically responsive particles are left attached to the cells that are to be subsequently incubated, cultured and/or engineered; in some aspects, the particles are left attached to the cells for administration to a patient. In some embodiments, the magnetizable or magnetically responsive particles are removed from the cells. Methods for removing magnetizable particles from cells are known and include, e.g., the use of competing non-labeled antibodies, magnetizable particles or antibodies conjugated to cleavable linkers, etc. In some embodiments, the magnetizable particles are biodegradable.

In some embodiments, the affinity-based selection is via magnetic-activated cell sorting (MACS) (Miltenyi Biotec, Auburn, Calif.). Magnetic Activated Cell Sorting (MACS) systems are capable of high-purity selection of cells having magnetized particles attached thereto. In certain embodiments, MACS operates in a mode wherein the non-target and target species are sequentially eluted after the application of the external magnetic field. That is, the cells attached to magnetized particles are held in place while the unattached species are eluted. Then, after this first elution step is completed, the species that were trapped in the magnetic field and were prevented from being eluted are freed in some manner such that they can be eluted and recovered. In certain embodiments, the non-target cells are labelled and depleted from the heterogeneous population of cells.

In certain embodiments, the isolation or separation is carried out using a system, device, or apparatus that carries out one or more of the isolation, cell preparation, separation, processing, incubation, culture, and/or formulation steps of the methods. In some aspects, the system is used to carry out each of these steps in a closed or sterile environment, for example, to minimize error, user handling and/or contamination. In one example, the system is a system as described in International Patent Application, Publication Number WO2009/072003, or US 2011/0003380 A1.

In some embodiments, the system or apparatus carries out one or more, e.g., all, of the isolation, processing, engineering, and formulation steps in an integrated or self-contained system, and/or in an automated or programmable fashion. In some aspects, the system or apparatus includes a computer and/or computer program in communication with the system or apparatus, which allows a user to program, control, assess the outcome of, and/or adjust various aspects of the processing, isolation, engineering, and formulation steps.

In some aspects, the separation and/or other steps is carried out using CliniMACS system (Miltenyi Biotec), for example, for automated separation of cells on a clinical-scale level in a closed and sterile system. Components can include an integrated microcomputer, magnetic separation unit, peristaltic pump, and various pinch valves. The integrated computer in some aspects controls all components of the instrument and directs the system to perform repeated procedures in a standardized sequence. The magnetic separation unit in some aspects includes a movable permanent magnet and a holder for the selection column. The peristaltic pump controls the flow rate throughout the tubing set and, together with the pinch valves, ensures the controlled flow of buffer through the system and continual suspension of cells.

The CliniMACS system in some aspects uses antibody-coupled magnetizable particles that are supplied in a sterile, non-pyrogenic solution. In some embodiments, after labelling of cells with magnetic particles the cells are washed to remove excess particles. A cell preparation bag is then connected to the tubing set, which in turn is connected to a bag containing buffer and a cell collection bag. The tubing set consists of pre-assembled sterile tubing, including a pre-column and a separation column, and are for single use only. After initiation of the separation program, the system automatically applies the cell sample onto the separation column. Labelled cells are retained within the column, while unlabeled cells are removed by a series of washing steps. In some embodiments, the cell populations for use with the methods described herein are unlabeled and are not retained in the column. In some embodiments, the cell populations for use with the methods described herein are labeled and are retained in the column. In some embodiments, the cell populations for use with the methods described herein are eluted from the column after removal of the magnetic field, and are collected within the cell collection bag.

In certain embodiments, separation and/or other steps are carried out using the CliniMACS Prodigy system (Miltenyi Biotec). The CliniMACS Prodigy system in some aspects is equipped with a cell processing unity that permits automated washing and fractionation of cells by centrifugation. The CliniMACS Prodigy system can also include an onboard camera and image recognition software that determines the optimal cell fractionation endpoint by discerning the macroscopic layers of the source cell product. For example, peripheral blood may be automatically separated into erythrocytes, white blood cells and plasma layers. The CliniMACS Prodigy system can also include an integrated cell cultivation chamber which accomplishes cell culture protocols such as, e.g., cell differentiation and expansion, antigen loading, and long-term cell culture. Input ports can allow for the sterile removal and replenishment of media and cells can be monitored using an integrated microscope. See, e.g., Klebanoff et al. (2012) J Immunother. 35(9): 651-660, Terakura et al. (2012) Blood. 1:72-82, and Wang et al. (2012) J Immunother. 35(9):689-701.

In some embodiments, a cell population described herein is collected and enriched (or depleted) via flow cytometry, in which cells stained for multiple cell surface markers are carried in a fluidic stream. In some embodiments, a cell population described herein is collected and enriched (or depleted) via preparative scale (FACS)-sorting. In certain embodiments, a cell population described herein is collected and enriched (or depleted) by use of microelectromechanical systems (MEMS) chips in combination with a FACS-based detection system (see, e.g., WO 2010/033140, Cho et al. (2010) *Lab Chip* 10, 1567-1573; and Godin et al. (2008) J Biophoton. 1(5):355-376. In both cases, cells can be labeled with multiple markers, allowing for the isolation of well-defined T cell subsets at high purity.

In some embodiments, the antibodies or binding partners are labeled with one or more detectable marker, to facilitate separation for positive and/or negative selection. For example, separation may be based on binding to fluorescently labeled antibodies. In some examples, separation of cells based on binding of antibodies or other binding partners specific for one or more cell surface markers are carried in a fluidic stream, such as by fluorescence-activated cell sorting (FACS), including preparative scale (FACS) and/or microelectromechanical systems (MEMS) chips, e.g., in combination with a flow-cytometric detection system. Such methods allow for positive and negative selection based on multiple markers simultaneously.

In some embodiments, the preparation methods include steps for freezing, e.g., cryopreserving, the cells, either before or after isolation, incubation, and/or engineering. In some embodiments, the freeze and subsequent thaw step removes granulocytes and, to some extent, monocytes in the cell population. In some embodiments, the cells are suspended in a freezing solution, e.g., following a washing step to remove plasma and platelets. Any of a variety of known freezing solutions and parameters in some aspects may be used. One example involves using PBS containing 20% DMSO and 8% human serum albumin (HSA), or other suitable cell freezing media. This is then diluted 1:1 with media so that the final concentration of DMSO and HSA are 10% and 4%, respectively. The cells are then frozen to −80° C. at a rate of 1° per minute and stored in the vapor phase of a liquid nitrogen storage tank.

In some embodiments, the provided methods include cultivation, incubation, culture, and/or genetic engineering steps. For example, in some embodiments, provided are methods for incubating and/or engineering the depleted cell populations and culture-initiating compositions.

Thus, in some embodiments, the cell populations are incubated in a culture-initiating composition. The incubation and/or engineering may be carried out in a culture vessel, such as a unit, chamber, well, column, tube, tubing set, valve, vial, culture dish, bag, or other container for culture or cultivating cells.

In some embodiments, the cells are incubated and/or cultured prior to or in connection with genetic engineering.

The incubation steps can include culture, cultivation, stimulation, activation, and/or propagation. In some embodiments, the compositions or cells are incubated in the presence of stimulating conditions or a stimulatory agent. Such conditions include those designed to induce proliferation, expansion, activation, and/or survival of cells in the population, to mimic antigen exposure, and/or to prime the cells for genetic engineering, such as for the introduction of an antigen receptor.

The conditions can include one or more of particular media, temperature, oxygen content, carbon dioxide content, time, agents, e.g., nutrients, amino acids, antibiotics, ions, and/or stimulatory factors, such as cytokines, chemokines, antigens, binding partners, fusion proteins, recombinant soluble receptors, and any other agents designed to activate the cells.

In some embodiments, the stimulating conditions or agents include one or more agent, e.g., ligand, which is capable of activating an intracellular signaling domain of a TCR complex. In some aspects, the agent turns on or initiates TCR/CD3 intracellular signaling cascade in a T cell. Such agents can include antibodies, such as those specific for a TCR component and/or costimulatory receptor, e.g., anti-CD3. In some embodiments, the stimulating conditions include one or more agent, e.g. ligand, which is capable of stimulating a costimulatory receptor, e.g., anti-CD28. In some embodiments, such agents and/or ligands may be, bound to solid support such as a bead, and/or one or more cytokines. Optionally, the expansion method may further comprise the step of adding anti-CD3 and/or anti CD28 antibody to the culture medium (e.g., at a concentration of at least about 0.5 ng/ml). In some embodiments, the stimulating agents include IL-2, IL-15 and/or IL-7. In some aspects, the IL-2 concentration is at least about 10 units/mL.

In some aspects, incubation is carried out in accordance with techniques such as those described in U.S. Pat. No. 6,040,177 to Riddell et al., Klebanoff et al. (2012) J Immunother. 35(9): 651-660, Terakura et al. (2012) Blood. 1:72-82, and/or Wang et al. (2012) J Immunother. 35(9):689-701.

In some embodiments, the T cells are expanded by adding to the culture-initiating composition feeder cells, such as non-dividing peripheral blood mononuclear cells (PBMC), (e.g., such that the resulting population of cells contains at least about 5, 10, 20, or 40 or more PBMC feeder cells for each T lymphocyte in the initial population to be expanded); and incubating the culture (e.g. for a time sufficient to expand the numbers of T cells). In some aspects, the non-dividing feeder cells can comprise gamma-irradiated PBMC feeder cells. In some embodiments, the PBMC are irradiated with gamma rays in the range of about 3000 to 3600 rads to prevent cell division. In some aspects, the feeder cells are added to culture medium prior to the addition of the populations of T cells.

In some embodiments, the stimulating conditions include temperature suitable for the growth of human T lymphocytes, for example, at least about 25 degrees Celsius, generally at least about 30 degrees, and generally at or about 37 degrees Celsius. Optionally, the incubation may further comprise adding non-dividing EBV-transformed lymphoblastoid cells (LCL) as feeder cells. LCL can be irradiated with gamma rays in the range of about 6000 to 10,000 rads. The LCL feeder cells in some aspects is provided in any suitable amount, such as a ratio of LCL feeder cells to initial T lymphocytes of at least about 10:1.

In embodiments, antigen-specific T cells, such as antigen-specific CD4+ and/or CD8+ T cells, are obtained by stimulating naive or antigen specific T lymphocytes with antigen. For example, antigen-specific T cell lines or clones can be generated to cytomegalovirus antigens by isolating T cells from infected subjects and stimulating the cells in vitro with the same antigen.

B. Vectors and Methods for Genetic Engineering

Also provided are methods, nucleic acids, compositions, and kits, for expressing the binding molecules, and for producing the genetically engineered cells expressing such binding molecules. The genetic engineering generally involves introduction of a nucleic acid encoding the binding molecule, e.g. TCR or CAR, e.g. TCR-like CAR, into the cell, such as by retroviral transduction, transfection, or transformation.

In some embodiments, gene transfer is accomplished by first stimulating the cell, such as by combining it with a stimulus that induces a response such as proliferation, survival, and/or activation, e.g., as measured by expression of a cytokine or activation marker, followed by transduction of the activated cells, and expansion in culture to numbers sufficient for clinical applications.

In some contexts, overexpression of a stimulatory factor (for example, a lymphokine or a cytokine) may be toxic to a subject. Thus, in some contexts, the engineered cells include gene segments that cause the cells to be susceptible to negative selection in vivo, such as upon administration in adoptive immunotherapy. For example in some aspects, the cells are engineered so that they can be eliminated as a result of a change in the in vivo condition of the patient to which they are administered. The negative selectable phenotype may result from the insertion of a gene that confers sensitivity to an administered agent, for example, a compound. Negative selectable genes include the Herpes simplex virus type I thymidine kinase (HSV-I TK) gene (Wigler et al., Cell 2:223, 1977) which confers ganciclovir sensitivity; the cellular hypoxanthine phosphribosyltransferase (HPRT) gene, the cellular adenine phosphoribosyltransferase (APRT) gene, bacterial cytosine deaminase, (Mullen et al., Proc. Natl. Acad. Sci. USA. 89:33 (1992)).

In some aspects, the cells further are engineered to promote expression of cytokines or other factors. Various methods for the introduction of genetically engineered components are well known and may be used with the provided methods and compositions. Exemplary methods include those for transfer of nucleic acids encoding the binding molecules, including via viral, e.g., retroviral or lentiviral, transduction, transposons, and electroporation.

In some embodiments, recombinant nucleic acids are transferred into cells using recombinant infectious virus particles, such as, e.g., vectors derived from simian virus 40 (SV40), adenoviruses, adeno-associated virus (AAV). In some embodiments, recombinant nucleic acids are transferred into T cells using recombinant lentiviral vectors or retroviral vectors, such as gamma-retroviral vectors (see, e.g., Koste et al. (2014) Gene Therapy 2014 Apr. 3. doi: 10.1038/gt.2014.25; Carlens et al. (2000) Exp Hematol 28(10): 1137-46; Alonso-Camino et al. (2013) Mol Ther Nucl Acids 2, e93; Park et al., Trends Biotechnol. 2011 Nov. 29(11): 550-557.

In some embodiments, the retroviral vector has a long terminal repeat sequence (LTR), e.g., a retroviral vector derived from the Moloney murine leukemia virus (MoMLV), myeloproliferative sarcoma virus (MPSV), murine embryonic stem cell virus (MESV), murine stem cell virus (MSCV), spleen focus forming virus (SFFV). Most retroviral vectors are derived from murine retroviruses. In some embodiments, the retroviruses include those derived from any avian or mammalian cell source. The retroviruses typically are amphotropic, meaning that they are capable of infecting host cells of several species, including humans. In one embodiment, the gene to be expressed replaces the retroviral gag, pol and/or env sequences. A number of illustrative retroviral systems have been described (e.g., U.S. Pat. Nos. 5,219,740; 6,207,453; 5,219,740; Miller and Rosman (1989) BioTechniques 7:980-990; Miller, A. D. (1990) Human Gene Therapy 1:5-14; Scarpa et al. (1991) Virology 180:849-852; Burns et al. (1993) Proc. Natl. Acad. Sci. USA 90:8033-8037; and Boris-Lawrie and Temin (1993) Cur. Opin. Genet. Develop. 3:102-109.

Methods of lentiviral transduction are known. Exemplary methods are described in, e.g., Wang et al. (2012) *J. Immunother.* 35(9): 689-701; Cooper et al. (2003) *Blood.* 101: 1637-1644; Verhoeyen et al. (2009)*Methods Mol Biol.* 506: 97-114; and Cavalieri et al. (2003) *Blood.* 102(2): 497-505.

In some embodiments, recombinant nucleic acids are transferred into T cells via electroporation (see, e.g., Chicaybam et al, (2013) *PLoS ONE* 8(3): e60298 and Van Tedeloo et al. (2000) *Gene Therapy* 7(16): 1431-1437). In some embodiments, recombinant nucleic acids are transferred into T cells via transposition (see, e.g., Manuri et al. (2010) *Hum Gene Ther* 21(4): 427-437; Sharma et al. (2013) *Molec Ther Nucl Acids* 2, e74; and Huang et al. (2009) *Methods Mol Biol* 506: 115-126). Other methods of introducing and expressing genetic material in immune cells include calcium phosphate transfection (e.g., as described in Current Protocols in Molecular Biology, John Wiley & Sons, New York. N.Y.), protoplast fusion, cationic liposome-mediated transfection; tungsten particle-facilitated microparticle bombardment (Johnston, Nature, 346: 776-777 (1990)); and strontium phosphate DNA co-precipitation (Brash et al., Mol. Cell Biol., 7: 2031-2034 (1987)).

Other approaches and vectors for transfer of the nucleic acids encoding the binding molecules or recombinant products are those described, e.g., in international patent application, Publication No.: WO2014/055668, and U.S. Pat. No. 7,446,190.

Among additional nucleic acids, e.g., genes for introduction are those to improve the efficacy of therapy, such as by promoting viability and/or function of transferred cells; genes to provide a genetic marker for selection and/or evaluation of the cells, such as to assess in vivo survival or localization; genes to improve safety, for example, by making the cell susceptible to negative selection in vivo as described by Lupton S. D. et al., *Mol. and Cell Biol.*, 11:6 (1991); and Riddell et al., *Human Gene Therapy* 3:319-338 (1992); see also the publications of PCT/US91/08442 and PCT/US94/05601 by Lupton et al. describing the use of bifunctional selectable fusion genes derived from fusing a dominant positive selectable marker with a negative selectable marker. See, e.g., Riddell et al., U.S. Pat. No. 6,040,177, at columns 14-17.

Thus, provided in some embodiments are engineered cells, such as those containing a binding molecule (such as TCR or antigen-binding fragment thereof or antibody or antigen-binding fragment thereof), nucleic acid, or vector as described herein. In some aspects, the cell is produced by transducing the cell in vitro or ex vivo with a vector described herein. In some aspects, the cell is a T cell, such as a CD8+ or CD4+ T cell. In some embodiments, the binding molecule is heterologous to the cell.

In some cases, the engineered cell contains a heterologous TCR or antigen-binding fragment thereof that recognizes or binds a peptide epitope derived from HPV16 E6. In some cases, the TCR or antigen-binding fragment thereof does not recognize or bind the epitope E6(29-38) comprising the amino acid sequence TIHDIILECV (SEQ ID NO. 233). In some instances, the TCR or antigen-binding fragment thereof that recognizes or binds a peptide epitope derived from HPV16 E6 is or comprises the sequence set forth in SEQ ID NO: 232 or SEQ ID NO: 234.

In some embodiments, the engineered cell contains a heterologous TCR or antigen-binding fragment thereof that recognizes or binds a peptide epitope derived from HPV16 E7. In some embodiments, the TCR or antigen-binding fragment thereof does not recognize or bind the epitope E7 (11-19) comprising the amino acid sequence YMLDLQPET (SEQ ID NO. 236). In some instances, the TCR or antigen-binding fragment thereof that recognizes or binds a peptide epitope derived from HPV16 E7 is or contains the sequence set forth in any of SEQ ID NOs: 235-239. In some cases, the peptide derived from HPV16 E7 is or contains the sequence set forth in SEQ ID NO: 235.

V. Methods for Editing Endogenous Genes Encoding T Cell Receptor (TCR) and Engineering of Cells to Express the Binding Molecules by Targeted Integration In some aspects, the provided binding molecules, e.g., recombinant T cell receptor (TCR) or a fragment or α chain thereof, are expressed in an engineered cell, e.g., an engineered T cell. In some embodiments, provided are genetically engineered T cells expressing any of the described binding molecules, e.g., recombinant TCRs or a fragment or α chain thereof, provided herein, e.g., for adoptive cell therapy, and related compositions, methods, uses, and kits and articles of manufacture used for performing the methods. In some aspects, one or more endogenous genes and/or gene products (and/or expression thereof) in the engineered cells are modified, e.g., by gene editing. In some aspects, the gene editing results in reduction, deletion, elimination, knock-out or disruption of one or more endogenous gene products (and/or expression thereof) and/or targeted integration of exogenous, heterologous or transgene sequences, e.g., sequences encoding the binding molecule, e.g., recombinant TCR, via methods such as homology-directed repair (HDR). In some embodiments, immune cells are engineered to express any of the binding molecules, e.g., recombinant TCRs, and sequences encoding the binding molecule, e.g., recombinant TCR, can be targeted to a specific locus via gene editing methods such as HDR.

In some embodiments, one or more endogenous genes and/or gene products (and/or expression thereof) in the provided cells, and/or compositions containing such cells, are reduced, deleted, eliminated, knocked-out or disrupted, e.g., by introduction of a genetic disruption such as a DNA break. In some embodiments, the genes and/or gene products, are reduced, deleted, eliminated, knocked-out or disrupted in any of the cells engineered to express any of the binding molecules, e.g., recombinant TCRs, provided herein. In some embodiments, provided are cells that have been engineered to express a binding molecule, e.g., a recombinant TCR, described herein, populations of such cells, compositions containing such cells and/or enriched for such cells.

In some embodiments, one or more endogenous genes and/or gene products (and/or expression thereof) in the provided cells, and/or compositions containing such cells, are reduced, deleted, eliminated, knocked-out or disrupted, including one or more of the gene encoding (or product thereof) TCR alpha constant region (TRAC) and/or TCR beta constant region (TRBC; encoded in humans by TRBC1 or TRBC2), e.g., to reduce or prevent expression of the endogenous TCR in the cell, e.g. T cell, and/or α chain thereof. In some embodiments, the genes and/or gene products, such as TRAC and/or TRBC, is reduced, deleted, eliminated, knocked-out or disrupted in any of the engineered cells provided herein and/or in any of the methods for producing engineered cells provided herein. In some embodiments, engineered cells and/or engineered cells produced by the methods are cells that have been engineered to express the binding molecule described herein, populations of such cells, compositions containing such cells and/or enriched for such cells. In some embodiments, genes and/or gene products, such as the TRAC and/or TRBC, is reduced, deleted, eliminated, knocked-out or disrupted in primary T cells, to reduce, delete, eliminate, knock-out or disrupt the expression of the endogenous TCR in primary T cells, e.g., that are engineered to express any of the T cell receptors described herein.

In some embodiments, gene editing, e.g., via HDR, involves: i) introducing into an immune cell one or more agent(s) capable of inducing a genetic disruption of one or more target site(s) within a gene encoding a domain or region of a T cell receptor alpha (TCRα) chain and/or one or more gene(s) encoding a domain or region of a T cell receptor beta (TCRβ) chain; and ii) introducing into the immune cell a polynucleotide, e.g., a template polynucleotide, comprising a transgene encoding a binding molecule, e.g., recombinant TCR or α chain thereof, such as any of the provided recombinant TCRs, wherein the transgene encoding the a binding molecule, e.g., recombinant TCR or α chain thereof is targeted at or near one of the at least one target site(s) via homology directed repair (HDR).

In some aspects, polynucleotides, e.g., template polynucleotides, containing transgene sequence (also referred to herein as exogenous or heterologous nucleic acid sequences) encoding a binding molecule, e.g., recombinant TCR or α chain thereof and sequences homologous to the region of genetic disruption, can be introduced into a cell containing a genetic disruption at the endogenous TRAC and/or TRBC loci. In some aspects, in the presence of the targeted genetic disruption, e.g., DNA break, the nucleic acid sequences can be used as a DNA repair template, to effectively copy and integrate the transgene sequence, e.g., nucleic acid sequences encoding the binding molecule, e.g., recombinant TCR or α chain thereof, at or near the site of the targeted genetic disruption by HDR, based on homology between the endogenous gene sequence surrounding the target site and the 5' and/or 3' homology arms included in the template polynucleotide.

In some embodiments, the genetically engineered cells are modified to contain TRAC and/or TRBC locus that contains nucleic acid sequences encoding any of the provided binding molecules, e.g., recombinant TCR or a fragment thereof. In some aspects, the TRAC and/or TRBC locus in the genetically engineered cell are modified, e.g., by gene editing, to include a transgene sequence encoding a binding molecule, e.g., recombinant TCR or α chain thereof, that is integrated into an endogenous TRAC and/or TRBC locus, which normally encodes a TCRα or TCRβ constant domains. In some embodiments, gene editing involves inducing a targeted genetic disruption in one or more of the endogenous genes encoding TCRα or TCRβ constant domains, and homology-dependent repair (HDR), using one or more template polynucleotides containing a transgene encoding a binding molecule, e.g., recombinant TCR or α chain thereof, thereby targeting integration of the transgene at the TRAC and/or TRBC locus. In some embodiments, the transgene encodes a portion of the recombinant TCR and is integrated in-frame into a TCR open reading frame and/or gene locus. In certain embodiments, the transgene encodes a portion of a recombinant TCR and is inserted in-frame within an endogenous open reading frame encoding a TCR constant domain. In some embodiments, the integration of the transgene into the locus modifies and/or results in a modified locus that encodes the full recombinant TCR.

A. Genetic Disruption of Endogenous TCR-Encoding Genes

In some embodiments, the targeted genetic disruption occurs at the endogenous genes that encode one or more domains, regions and/or chains of the endogenous T cell receptor (TCR). In some embodiments, the genetic disruption is targeted at the endogenous gene loci that encode TCRα and/or the TCRβ. In some embodiments, the genetic disruption is targeted at the gene encoding TCRα constant domain (TRAC in humans) and/or TCRβ constant domain (TRBC1 or TRBC2 in humans).

In some embodiments, the genes and/or gene products targeted for reduction, deletion, elimination, knock-out or disruption are endogenous genes encoding the TCR or α chain, a domain and/or a region thereof. In some embodiments, a target site for disruption is in a T cell receptor alpha constant (TRAC) gene. In some embodiments, a target site for disruption is in a T cell receptor beta constant 1 (TRBC1) or T cell receptor beta constant 2 (TRBC2) gene. In some embodiments, the one or more target site(s) is in a TRAC gene and one or both of a TRBC1 and a TRBC2 gene.

In some embodiments, the endogenous TCR Cα is encoded by the TRAC gene (IMGT nomenclature). An exemplary nucleotide sequence of the human T cell receptor alpha constant chain (TRAC) gene locus is set forth in SEQ ID NO: 348 (NCBI Reference Sequence: NG_001332.3, TRAC). In some embodiments, the endogenous TCR Cβ is encoded by TRBC1 or TRBC2 genes (IMGT nomenclature). An exemplary nucleotide sequence of the human T cell receptor beta constant chain 1 (TRBC1) gene locus is set forth in SEQ ID NO:349 (NCBI Reference Sequence: NG_001333.2, TRBC1); and an exemplary nucleotide sequence of the human T cell receptor beta constant chain 2 (TRBC2) gene locus is set forth in SEQ ID NO:1047 (NCBI Reference Sequence: NG_001333.2, TRBC2).

In some embodiments, the endogenous TCR Cα is encoded by the TRAC gene (IMGT nomenclature). An exemplary sequence of the human T cell receptor alpha chain constant domain (TRAC) gene locus is set forth in SEQ ID NO:348 (NCBI Reference Sequence: NG_001332.3, TRAC). In certain embodiments, a genetic disruption is targeted at, near, or within a TRAC locus. In particular embodiments, the genetic disruption is targeted at, near, or within an open reading frame of the TRAC locus. In certain embodiments, the genetic disruption is targeted at, near, or within an open reading frame that encodes a TCRα constant domain. In some embodiments, the genetic disruption is targeted at, near, or within a locus having the nucleic acid sequence set forth in SEQ ID NO: 348, or a sequence having at or at least 70%, 75%, 80%, 85%, 90%, 95%, 97%, 98%, 99%, 99.5%, or 99.9% sequence identity to all or a portion, e.g., at or at least 500, 1,000, 1,500, 2,000, 2,500, 3,000, 3,500, or 4,000 contiguous nucleotides, of the nucleic acid sequence set forth in SEQ ID NO: 348.

In humans, an exemplary genomic locus of TRAC comprises an open reading frame that contains 4 exons and 3 introns. An exemplary mRNA transcript of TRAC can span the sequence corresponding to coordinates Chromosome 14: 22,547,506-22,552,154, on the forward strand, with reference to human genome version GRCh38 (UCSC Genome Browser on Human December 2013 (GRCh38/hg38) Assembly). Table 13 sets forth the coordinates of the exons and introns of the open reading frames and the untranslated regions of the transcript of an exemplary human TRAC locus.

TABLE 13

Coordinates of exons and introns of exemplary human TRAC locus (GRCh38, Chromosome 14, forward strand).

|  | Start (GrCh38) | End (GrCh38) | Length |
| --- | --- | --- | --- |
| 5' UTR and Exon 1 | 22,547,506 | 22,547,778 | 273 |
| Intron 1-2 | 22,547,779 | 22,549,637 | 1,859 |
| Exon 2 | 22,549,638 | 22,549,682 | 45 |
| Intron 2-3 | 22,549,683 | 22,550,556 | 874 |
| Exon 3 | 22,550,557 | 22,550,664 | 108 |
| Intron 3-4 | 22,550,665 | 22,551,604 | 940 |
| Exon 4 and 3' UTR | 22,551,605 | 22,552,154 | 550 |

In some embodiments, the endogenous TCR Cβ is encoded by TRBC1 or TRBC2 genes (IMGT nomenclature). An exemplary sequence of the human T cell receptor beta chain constant domain 1 (TRBC1) gene locus is set forth in SEQ ID NO:349 (NCBI Reference Sequence: NG_001333.2, TRBC1); and an exemplary sequence of the human T cell receptor beta chain constant domain 2 (TRBC2) gene locus is set forth in SEQ ID NO:1047 (NCBI Reference Sequence: NG_001333.2, TRBC2). In some embodiments, a genetic disruption is targeted at, near, or within the TRBC1 gene locus. In particular embodiments, the genetic disruption is targeted at, near, or within an open reading frame of the TRBC1 locus. In certain embodiments, the genetic disruption is targeted at, near, or within an open reading frame that encodes a TCRβ constant domain. In some embodiments, the genetic disruption is targeted at, near, or within a locus having the nucleic acid sequence set forth in SEQ ID NO: 349, or a sequence having at or at least 70%, 75%, 80%, 85%, 90%, 95%, 97%, 98%, 99%, 99.5%, or 99.9% sequence identity to all or a portion, e.g., at or at least 500, 1,000, 1,500, 2,000, 2,500, 3,000, 3,500, or 4,000 contiguous nucleotides, of the nucleic acid sequence set forth in SEQ ID NO: 349.

In humans, an exemplary genomic locus of TRBC1 comprises an open reading frame that contains 4 exons and 3 introns. An exemplary mRNA transcript of TRBC1 can span the sequence corresponding to coordinates Chromosome 7: 142,791,694-142,793,368, on the forward strand, with reference to human genome version GRCh38 (UCSC Genome Browser on Human December 2013 (GRCh38/hg38) Assembly). Table 14 sets forth the coordinates of the exons and introns of the open reading frames and the untranslated regions of the transcript of an exemplary human TRBC1 locus.

TABLE 14

Coordinates of exons and introns of exemplary human TRBCI locus (GRCh38, Chromosome 7, forward strand).

|  | Start (GrCh38) | End (GrCh38) | Length |
| --- | --- | --- | --- |
| 5' UTR and Exon 1 | 142,791,694 | 142,792,080 | 387 |
| Intron 1-2 | 142,792,081 | 142,792,521 | 441 |
| Exon 2 | 142,792,522 | 142,792,539 | 18 |
| Intron 2-3 | 142,792,540 | 142,792,691 | 152 |
| Exon 3 | 142,792,692 | 142,792,798 | 107 |

TABLE 14-continued

Coordinates of exons and introns of exemplary human TRBCI locus (GRCh38, Chromosome 7, forward strand).

|  | Start (GrCh38) | End (GrCh38) | Length |
| --- | --- | --- | --- |
| Intron 3-4 | 142,792,799 | 142,793,120 | 322 |
| Exon 4 and 3' UTR | 142,793,121 | 142,793,368 | 248 |

In particular embodiments, a genetic disruption is targeted at, near, or within the TRBC2 locus. In particular embodiments, the genetic disruption is targeted at, near, or within an open reading frame of the TRBC2 locus. In certain embodiments, the genetic disruption is targeted at, near, or within an open reading frame that encodes a TCRβ constant domain. In some embodiments, the genetic disruption is targeted at, near, or within a locus having the nucleic acid sequence set forth in SEQ ID NO:1047, or a sequence having at or at least 70%, 75%, 80%, 85%, 90%, 95%, 97%, 98%, 99%, 99.5%, or 99.9% sequence identity to all or a portion, e.g., at or at least 500, 1,000, 1,500, 2,000, 2,500, 3,000, 3,500, or 4,000 contiguous nucleotides, of the nucleic acid sequence set forth in SEQ ID NO:1047.

In humans, an exemplary genomic locus of TRBC2 comprises an open reading frame that contains 4 exons and 3 introns. An exemplary mRNA transcript of TRBC2 can span the sequence corresponding to coordinates Chromosome 7: 142,801,041-142,802,748, on the forward strand, with reference to human genome version GRCh38 (UCSC Genome Browser on Human December 2013 (GRCh38/hg38) Assembly). Table 15 sets forth the coordinates of the exons and introns of the open reading frames and the untranslated regions of the transcript of an exemplary human TRBC2 locus.

TABLE 15

Coordinates of exons and introns of exemplary human TRBC2 locus (GRCh38, Chromosome 7, forward strand).

|  | Start (GrCh38) | End (GrCh38) | Length |
| --- | --- | --- | --- |
| 5' UTR and Exon 1 | 142,801,041 | 142,801,427 | 387 |
| Intron 1-2 | 142,801,428 | 142,801,943 | 516 |
| Exon 2 | 142,801,944 | 142,801,961 | 18 |
| Intron 2-3 | 142,801,962 | 142,802,104 | 143 |
| Exon 3 | 142,802,105 | 142,802,211 | 107 |
| Intron 3-4 | 142,802,212 | 142,802,502 | 291 |
| Exon 4 and 3' UTR | 142,802,503 | 142,802,748 | 246 |

In some embodiments, gene(s) targeted for disruption or knock-out is at or near one or more of the TRAC, TRBC1 and/or TRBC2 loci. In some embodiments, the TRAC gene is knocked out. In some embodiments, the TRBC1 gene is knocked out. In some embodiments, the TRBC2 gene is knocked out. In some embodiments, the TRAC gene and the TRBC1 gene are knocked out. In some embodiments, the TRAC gene and the TRBC2 gene are knocked out. In some embodiments, the TRAC gene and both the TRBC1 and TRBC2 genes are knocked out, e.g., targeting a sequence that is conserved between TRBC1 and TRBC2.

In some embodiments, reducing or preventing endogenous TCR expression can lead to a reduced risk or chance of mispairing between chains of the engineered TCR and the endogenous TCR, thereby creating a new TCR that could potentially result in a higher risk of undesired or unintended antigen recognition and/or side effects, and/or could reduce expression levels of the desired exogenous TCR. In some aspects, reducing or preventing endogenous TCR expression can increase expression of the engineered TCR in the cells as compared to cells in which expression of the TCR is not reduced or prevented, such as increased by 1.5-fold, 2-fold, 3-fold, 4-fold, 5-fold or more. For example, in some cases, suboptimal expression of an engineered or recombinant TCR can occur due to competition with an endogenous TCR and/or with TCRs having mispaired chains, for the invariant CD3 signaling molecules that are involved in permitting expression of the complex on the cell surface.

In some embodiments, the reduction, deletion, elimination, knockout or disruption involve the use of one or more agent(s) capable of introducing a genetic disruption, a cleavage, a double strand break (DSB) and/or a nick at a target site in the genomic DNA, resulting in a the reduction, deletion, elimination, knockout or disruption after repair by various cellular DNA repair mechanisms.

In some embodiments, the one or more agent(s) capable of introducing a cleavage comprises a DNA binding protein or DNA-binding nucleic acid that specifically binds to or hybridizes to a target site in the genome, e.g., in TRAC and/or TRBC genes. In some aspects, the targeted cleavage, e.g., DNA break, of the endogenous genes encoding TCR is achieved using a protein or a nucleic acid is coupled to or complexed with a gene editing nuclease, such as in a chimeric or fusion protein. In some embodiments, the one or more agent(s) capable of introducing a cleavage comprises a fusion protein comprising a DNA-targeting protein and a nuclease or an RNA-guided nuclease.

In some embodiments, reduction, deletion, elimination, knockout or disruption is carried out by gene editing methods, such as using a zinc finger nuclease (ZFN), TALEN or a CRISPR/Cas system with an engineered single guide RNA that cleaves a TCR gene. In some embodiments, reducing expression of an endogenous TCR is carried out using an inhibitory nucleic acid molecule against a target nucleic acids encoding specific TCRs (e.g., TCR-α and TCR-β). In some embodiments, the inhibitory nucleic acid is or contains or encodes a small interfering RNA (siRNA), a microRNA-adapted shRNA, a short hairpin RNA (shRNA), a hairpin siRNA, a microRNA (miRNA-precursor) or a microRNA (miRNA). Exemplary methods for reducing or preventing endogenous TCR expression are known in the art, see e.g. U.S. Pat. No. 9,273,283; U.S. publication no. US2014/0301990; and PCT publication No. WO2015/161276.

In some embodiments, the agent capable of introducing a targeted cleavage comprises various components, such as a fusion protein comprising a DNA-targeting protein and a nuclease or an RNA-guided nuclease. In some embodiments, the targeted cleavage is carried out using a DNA-targeting molecule that includes a DNA-binding protein such as one or more zinc finger protein (ZFP) or transcription activator-like effectors (TALEs), fused to a nuclease, such as an endonuclease. In some embodiments, the targeted cleavage is carried out using RNA-guided nucleases such as a clustered regularly interspaced short palindromic nucleic acid (CRISPR)-associated nuclease (Cas) system (including Cas and/or Cfp1). In some embodiments, the targeted cleavage is carried using agents capable of introducing a cleavage, such as sequence-specific or targeted nucleases, including DNA-binding targeted nucleases and gene editing nucleases such as zinc finger nucleases (ZFN) and transcription activator-like effector nucleases (TALENs), and RNA-guided nucleases such as a CRISPR-associated nuclease (Cas) system, specifically engineered and/or designed to be targeted to the at least one target site(s), sequence of a gene or a portion thereof.

1. Engineered Nucleases

In some embodiments, the one or more agent(s) specifically targets the at least one target site(s), e.g., at or near TRAC and/or TRBC genes. In some embodiments, the agent comprises a ZFN, TALEN or a CRISPR/Cas9 combination that specifically binds to, recognizes, or hybridizes to the target site(s). In some embodiments, the CRISPR/Cas9 system includes an engineered crRNA/tracr RNA ("single guide RNA") to guide specific cleavage. In some embodiments, the agent comprises nucleases based on the Argonaute system (e.g., from *T. thermophilus*, known as 'TtAgo', (Swarts et al. (2014) Nature 507(7491): 258-261).

Zinc finger proteins (ZFPs), transcription activator-like effectors (TALEs), and CRISPR system binding domains can be "engineered" to bind to a predetermined nucleotide sequence, for example via engineering (altering one or more amino acids) of the recognition helix region of a naturally occurring ZFP or TALE protein. Engineered DNA binding proteins (ZFPs or TALEs) are proteins that are non-naturally occurring. Rational criteria for design include application of substitution rules and computerized algorithms for processing information in a database storing information of existing ZFP and/or TALE designs and binding data. See, e.g., U.S. Pat. Nos. 6,140,081; 6,453,242; and 6,534,261; see also WO 98/53058; WO 98/53059; WO 98/53060; WO 02/016536 and WO 03/016496 and U.S. Publication No. 20110301073. Exemplary ZFNs, TALEs, and TALENs are described in, e.g., Lloyd et al., Frontiers in Immunology, 4(221): 1-7 (2013).

In some embodiments, an engineered zinc finger protein, TALE protein or CRISPR/Cas system is not found in nature and whose production results primarily from an empirical process such as phage display, interaction trap or hybrid selection. See e.g., U.S. Pat. Nos. 5,789,538; 5,925,523; 6,007,988; 6,013,453; 6,200,759; WO 95/19431; WO 96/06166; WO 98/53057; WO 98/54311; WO 00/27878; WO 01/60970; WO 01/88197 and WO 02/099084.

In some embodiments, the TRAC and/or TRBC genes can be targeted for cleavage by engineered ZFNs. Exemplary ZFN that target endogenous T cell receptor (TCR) genes include those described in, e.g., US 2015/0164954, US 2011/0158957, US 2015/0056705, U.S. Pat. No. 8,956,828 and Torikawa et al. (2012) Blood 119:5697-5705, the disclosures of which are incorporated by reference in their entireties.

In some embodiments, the TRAC and/or TRBC genes can be targeted for cleavage by engineered TALENs. Exemplary TALEN that target endogenous T cell receptor (TCR) genes include those described in, e.g., WO 2017/070429, WO 2015/136001, US20170016025 and US20150203817, the disclosures of which are incorporated by reference in their entireties.

2 CRISPR Related Methods

In some embodiments, the TRAC and/or TRBC genes can be targeted for cleavage using clustered regularly interspaced short palindromic repeats (CRISPR) and CRISPR-associated (Cas) proteins. See Sander and Joung, (2014) *Nature Biotechnology*, 32(4): 347-355. In some embodiments, "CRISPR system" refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), and/or other sequences and transcripts from a CRISPR locus.

In some aspects, the CRISPR/Cas nuclease or CRISPR/Cas nuclease system includes a non-coding guide RNA (gRNA), which sequence-specifically binds to DNA, and a Cas protein (e.g., Cas9), with nuclease functionality.

In some embodiments, gene editing results in an insertion or a deletion at the targeted locus, or a "knock-out" of the targeted locus and elimination of the expression of the encoded protein. In some embodiments, the gene editing is achieved by non-homologous end joining (NHEJ) using a CRISPR/Cas9 system. In some embodiments, one or more guide RNA (gRNA) molecule can be used with one or more Cas9 nuclease, Cas9 nickase, enzymatically inactive Cas9 or variants thereof. Exemplary features of the gRNA molecule(s) and the Cas9 molecule(s) are described below.

In some embodiments, the CRISPR/Cas nuclease system comprises at least one of: a guide RNA (gRNA) having a targeting domain that is complementary with a target site of a TRAC gene; a gRNA having a targeting domain that is complementary with a target site of one or both of a TRBC1 and a TRBC2 gene; or at least one nucleic acid encoding the gRNA.

In some embodiments, a guide sequence, e.g., guide RNA, is any polynucleotide sequences comprising at least a sequence portion, e.g., targeting domain, that has sufficient complementarity with a target site sequence, such as a target site in the TRAC, TRBC1 and/or TRBC2 genes in humans, to hybridize with the target sequence at the target site and direct sequence-specific binding of the CRISPR complex to the target sequence. In some embodiments, in the context of formation of a CRISPR complex, "target site" (also known as "target position," "target DNA sequence" or "target location") can refer to a sequence to which a guide sequence is designed to have complementarity, where hybridization between the target sequence and a domain, e.g., targeting domain, of the guide RNA promotes the formation of a CRISPR complex. Full complementarity is not necessarily required, provided there is sufficient complementarity to cause hybridization and promote formation of a CRISPR complex. In some embodiments, a guide sequence is selected to reduce the degree of secondary structure within the guide sequence. Secondary structure may be determined by any suitable polynucleotide folding algorithm.

In some aspects, a CRISPR enzyme (e.g. Cas9 nuclease) in combination with (and optionally complexed with) a guide sequence is delivered to the cell. For example, one or more elements of a CRISPR system is derived from a type I, type II, or type III CRISPR system. For example, one or more elements of a CRISPR system are derived from a particular organism comprising an endogenous CRISPR system, such as *Streptococcus pyogenes, Staphylococcus aureus* or *Neisseria meningitides*.

In some embodiments, a guide RNA (gRNA) specific to the target site (e.g. TRAC, TRBC1 and/or TRBC2 in humans) is used with RNA-guided nucleases, e.g., Cas, to introduce a DNA break at the target site or target position. Methods for designing gRNAs and exemplary targeting domains can include those described in, e.g., International PCT Publication No. WO2015/161276. Targeting domains can be incorporated into the gRNA that is used to target Cas9 nucleases to the target site or target position.

Methods for selection and validation of target sequences as well as off-target analyses are described, e.g., in Mali et al., 2013 SCIENCE 339(6121): 823-826; Hsu et al. NAT BIOTECHNOL, 31(9): 827-32; Fu et al., 2014 NAT BIOTECHNOL, doi: 10.1038/nbt.2808. PubMed PMID: 24463574; Heigwer et al., 2014 NAT METHODS 11(2):122-3. doi: 10.1038/nmeth.2812. PubMed PMID: 24481216; Bae et al., 2014 BIOINFORMATICS PubMed PMID: 24463181; Xiao A et al., 2014 BIOINFORMATICS PubMed PMID: 24389662. A genome-wide gRNA database for CRISPR genome editing is publicly available, which contains exemplary single guide RNA (sgRNA) sequences targeting constitutive exons of genes in the human genome or mouse genome (see e.g., genescript.com/gRNA-database.html; see also, Sanjana et al. (2014) Nat. Methods, 11:783-4). In some aspects, the gRNA sequence is or comprises a sequence with minimal off-target binding to a non-target site or position.

a) Guide RNA (gRNA) Molecules

In some embodiments, the agent comprises a gRNA that targets a region of the TRAC, TRBC1 and/or TRBC2 loci. A "gRNA molecule" refers to a nucleic acid that promotes the specific targeting or homing of a gRNA molecule/Cas9 molecule complex to a target nucleic acid, such as a locus on the genomic DNA of a cell. gRNA molecules can be unimolecular (having a single RNA molecule), sometimes referred to herein as "chimeric" gRNAs, or modular (comprising more than one, and typically two, separate RNA molecules).

Several exemplary gRNA structures, with domains indicated thereon, are provided in FIGS. 14A-14G. While not wishing to be bound by theory, with regard to the three dimensional form, or intra- or inter-strand interactions of an active form of a gRNA, regions of high complementarity are sometimes shown as duplexes in FIGS. 14A-14G and other depictions provided herein.

In some cases, the gRNA is a unimolecular or chimeric gRNA comprising, from 5' to 3': a targeting domain which is complementary to a target nucleic acid, such as a sequence from the TRAC, TRBC1 and/or TRBC2 genes (coding sequences set forth in SEQ ID NOS: 348, 349 and 1047, respectively); a first complementarity domain; a linking domain; a second complementarity domain (which is complementary to the first complementarity domain); a proximal domain; and optionally, a tail domain.

In other cases, the gRNA is a modular gRNA comprising first and second strands. In these cases, the first strand preferably includes, from 5' to 3': a targeting domain (which is complementary to a target nucleic acid, such as a sequence from the TRAC, TRBC1 and/or TRBC2 genes, coding sequence set forth in SEQ ID NOS: 348, 349 and 1047, respectively) and a first complementarity domain. The second strand generally includes, from 5' to 3': optionally, a 5' extension domain; a second complementarity domain; a proximal domain; and optionally, a tail domain.

In some cases, the gRNA is a unimolecular or chimeric gRNA comprising, from 5' to 3': a targeting domain which targets a target site or position, such within as a sequence from the TRAC locus (exemplary nucleotide sequence of the human TRAC gene locus set forth in SEQ ID NO:348; NCBI Reference Sequence: NG_001332.3, TRAC; exemplary genomic sequence described in Table 13 herein); a first complementarity domain; a linking domain; a second complementarity domain (which is complementary to the first complementarity domain); a proximal domain; and optionally, a tail domain. In some cases, the gRNA is a unimolecular or chimeric gRNA comprising, from 5' to 3': a targeting domain which targets a target site or position, such as within a sequence from the TRBC1 or TRBC2 locus (exemplary nucleotide sequence of the human TRBC1 gene locus set forth in SEQ ID NO: 349; NCBI Reference Sequence: NG_001333.2, TRBC1; exemplary genomic sequence described in Table 14 herein; exemplary nucleotide sequence of the human TRBC2 gene locus set forth in SEQ ID NO:1047; NCBI Reference Sequence: NG_001333.2, TRBC2; exemplary genomic sequence described in Table 15 herein); a first complementarity domain; a linking domain; a second complementarity domain (which is complementary to the first complementarity domain); a proximal domain; and optionally, a tail domain.

In other cases, the gRNA is a modular gRNA comprising first and second strands. In these cases, the first strand preferably includes, from 5' to 3': a targeting domain (which targets a target site or position, such as within a sequence from TRAC locus (exemplary nucleotide sequence of the human TRAC gene locus set forth in SEQ ID NO:348; NCBI Reference Sequence: NG_001332.3, TRAC; exemplary genomic sequence described in Table 13 herein) or TRBC1 or TRBC2 locus (exemplary nucleotide sequence of the human TRBC1 gene locus set forth in SEQ ID NO: 349; NCBI Reference Sequence: NG_001333.2, TRBC11; exemplary genomic sequence described in Table 14 herein; exemplary nucleotide sequence of the human TRBC2 gene locus set forth in SEQ ID NO:1047; NCBI Reference Sequence: NG_001333.2, TRBC2); and a first complementarity domain. The second strand generally includes, from 5' to 3': optionally, a 5' extension domain; a second complementarity domain; a proximal domain; and optionally, a tail domain.

These domains are discussed briefly below:

(1) The Targeting Domain

FIGS. 14A-14G provide examples of the placement of targeting domains.

The targeting domain comprises a nucleotide sequence that is complementary, e.g., at least 80, 85, 90, 95, 98 or 99% complementary, e.g., fully complementary, to the target sequence on the target nucleic acid. The strand of the target nucleic acid comprising the target sequence is referred to herein as the "complementary strand" of the target nucleic acid. Guidance on the selection of targeting domains can be found, e.g., in Fu Y et al., Nat Biotechnol 2014 (doi: 10.1038/nbt.2808) and Sternberg S H et al., Nature 2014 (doi: 10.1038/nature13011).

The targeting domain is part of an RNA molecule and will therefore comprise the base uracil (U), while any DNA encoding the gRNA molecule will comprise the base thymine (T). While not wishing to be bound by theory, in an embodiment, it is believed that the complementarity of the targeting domain with the target sequence contributes to specificity of the interaction of the gRNA molecule/Cas9 molecule complex with a target nucleic acid. It is understood that in a targeting domain and target sequence pair, the uracil bases in the targeting domain will pair with the adenine bases in the target sequence. In an embodiment, the target domain itself comprises in the 5' to 3' direction, an optional secondary domain, and a core domain. In an embodiment, the core domain is fully complementary with the target sequence. In an embodiment, the targeting domain is 5 to 50 nucleotides in length. The strand of the target nucleic acid with which the targeting domain is complementary is referred to herein as the complementary strand. Some or all of the nucleotides of the domain can have a modification, e.g., to render it less susceptible to degradation, improve bio-compatibility, etc. By way of non-limiting example, the backbone of the target domain can be modified with a phosphorothioate, or other modification(s). In some cases, a nucleotide of the targeting domain can comprise a 2' modification, e.g., a 2-acetylation, e.g., a 2' methylation, or other modification(s).

In various embodiments, the targeting domain is 16-26 nucleotides in length (i.e. it is 16 nucleotides in length, or 17 nucleotides in length, or 18, 19, 20, 21, 22, 23, 24, 25 or 26 nucleotides in length.

(2) Exemplary Targeting Domains

In some embodiments, when the T cell target knockout position is the TRAC coding region, e.g., an early coding region, and more than one gRNA is used to position breaks, e.g., two single stranded breaks or two double stranded breaks, or a combination of single strand and double strand breaks, e.g., to create one or more indels, in the target nucleic acid sequence, each guide RNA is independently selected from one of Tables 25A-G or Table 29 of International PCT Pub. No. WO2015161276.

In another embodiment, when the T cell target knockout position is the TRAC coding region, e.g., an early coding region, and more than one gRNA is used to position breaks, e.g., two single stranded breaks or two double stranded breaks, or a combination of single strand and double strand breaks, e.g., to create one or more indels, in the target nucleic acid sequence, each guide RNA is independently selected from one of Tables 25A-G or Table 29 of International PCT Pub. No. WO2015161276 so that the break is generated with over 10% efficiency.

In an embodiment, when the T cell target knockout position is the TRBC coding region, e.g., an early coding region, and more than one gRNA is used to position breaks, e.g., two single stranded breaks or two double stranded breaks, or a combination of single strand and double strand breaks, e.g., to create one or more indels, in the target nucleic acid sequence, each guide RNA is independently selected from one of Tables 26A-G or Table 27 of International PCT Pub. No. WO2015161276.

In an embodiment, when the T cell target knockout position is the TRBC coding region, e.g., an early coding region, and more than one gRNA is used to position breaks, e.g., two single stranded breaks or two double stranded breaks, or a combination of single strand and double strand breaks, e.g., to create one or more indels, in the target nucleic acid sequence, each guide RNA is independently selected from one of Tables 26A-G or Table 27 of International PCT Pub. No. WO2015161276 so that the break is generated with over 10% efficiency.

In some embodiments, exemplary guide RNA targeting domain sequence includes any of those described in International PCT Pub. No. WO2015161276. In some embodiments, exemplary guide RNA sequences are described below, with reference to the Tables set forth in International PCT Pub. No. WO2015161276, the content of which are incorporated herein in their entirety.

Table 25A of International PCT Pub. No. WO2015161276 provides targeting domains for knocking out the TRAC gene using *S. pyogenes* Cas9 selected according to first tier parameters. The targeting domains bind within the first 500 bp of coding sequence downstream of start codon and have good orthogonality. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp. In an embodiment, two gRNAs are used to target two Cas9 nucleases or two Cas9 nickases, e.g., a gRNA with a targeting domain from Group A can be paired with a gRNA with a targeting domain from Group B as shown in Table 25-1 of International PCT Pub. No. WO2015161276.

Table 25B of International PCT Pub. No. WO2015161276 provides targeting domains for knocking out the TRAC gene using *S. pyogenes* Cas9 selected according to second tier parameters. The targeting domains bind within the first 500 bp of coding sequence downstream of start codon and good orthogonality is not required. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp.

Table 25C of International PCT Pub. No. WO2015161276 provides targeting domains for knocking out the TRAC gene using *S. aureus* Cas9 selected according to first tier parameters. The targeting domains were selected within the first 500 bp of the coding sequence, had a high level of orthogonality, and contained a NNGRRT PAM. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase). In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp. In an embodiment, two gRNAs are used to target two Cas9 nucleases or two Cas9 nickases, e.g., a gRNA with a targeting domain from Group A can be paired with a gRNA with a targeting domain from Group B as shown in Table 25-2 of International PCT Pub. No. WO201516127.

Table 25D of International PCT Pub. No. WO2015161276 provides targeting domains for knocking out the TRAC gene using *S. aureus* Cas9 selected according to second tier parameters. The targeting domains were selected within the first 500 bp of the coding sequence, no level of orthogonality was required, and contained a NNGRRT PAM. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase). In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp.

Table 25E of International PCT Pub. No. WO2015161276 provides targeting domains for knocking out the TRAC gene using *S. aureus* Cas9 selected according to third tier parameters. The targeting domains were selected within the remainder of the coding sequence downstream and contained a NNGRRT PAM. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase). In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp.

Table 25F of International PCT Pub. No. WO2015161276 provides targeting domains for knocking out the TRAC gene using *N. meningitides* Cas9 selected according to first tier parameters. The targeting domains bind within the first 500 bp of coding sequence downstream of start codon and have good orthogonality. It is contemplated herein that the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase). In an embodiment, dual targeting is used to create two nicks on opposite DNA strands by using *N. meningitidis* nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp.

Table 25G of International PCT Pub. No. WO2015161276 provides targeting domains for knocking out the TRAC gene using *N. meningitidis* Cas9 selected according to second tier parameters. The targeting domains bind within the first 500 bp of coding sequence downstream of start codon and good orthogonality is not required. It is contemplated herein that the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase). In an embodiment, dual targeting is used to create two nicks on opposite DNA strands by using *N. meningitidis* Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp.

Table 26A of International PCT Pub. No. WO2015161276 provides targeting domains for knocking out the TRBC gene using S. pyogenes Cas9 selected according to first tier parameters. The targeting domains bind within the first 500 bp of coding sequence downstream of start codon and have good orthogonality. It is contemplated herein that the targeting domain hybridizes to the target domain through complementary base pairing. Any of the targeting domains in the table can be used with a S. pyogenes Cas9 molecule that generates a double stranded break (Cas9 nuclease) or a single-stranded break (Cas9 nickase). In an embodiment, dual targeting is used to create two nicks on opposite DNA strands by using S. pyogenes Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp. In an embodiment, two gRNAs are used to target two Cas9 nucleases or two Cas9 nickases, e.g., a gRNA with a targeting domain from Group A can be paired with a gRNA with a targeting domain from Group B as shown in Table 26-1 of International PCT Pub. No. WO201516127.

Table 26B of International PCT Pub. No. WO2015161276 provides targeting domains for knocking out the TRBC gene using S. pyogenes Cas9 selected according to second tier parameters. The targeting domains bind within the first 500 bp of coding sequence downstream of start codon and good orthogonality is not required. It is contemplated herein that the targeting domain hybridizes to the target domain through complementary base pairing. Any of the targeting domains in the table can be used with a S. pyogenes Cas9 molecule that generates a double stranded break (Cas9 nuclease) or a single-stranded break (Cas9 nickase). In an embodiment, dual targeting is used to create two nicks on opposite DNA strands by using S. pyogenes Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp.

Table 26C of International PCT Pub. No. WO2015161276 provides targeting domains for knocking out the TRBC gene using S. aureus Cas9 selected according to first tier parameters. The targeting domains were selected within the first 500 bp of the coding sequence, had a high level of orthogonality, and contained an N GRRT PAM. It is contemplated herein that the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase). In an embodiment, dual targeting is used to create two nicks on opposite DNA strands by using S. aureus Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp. In an embodiment, two gRNAs are used to target two Cas9 nucleases or two Cas9 nickases, e.g., a gRNA with a targeting domain from Group A can be paired with a gRNA with a targeting domain from Group B as shown in Table 26-2 of International PCT Pub. No. WO201516127.

Table 26D of International PCT Pub. No. WO2015161276 provides targeting domains for knocking out the TRBC gene using S. aureus Cas9 selected according to second tier parameters. The targeting domains were selected within the first 500 bp of the coding sequence, no level of orthogonality was required, and contained a NNGRRT PAM. It is contemplated herein that the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase). In an embodiment, dual targeting is used to create two nicks on opposite DNA strands by using S. aureus Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp.

Table 26E of International PCT Pub. No. WO2015161276 provides targeting domains for knocking out the TRBC gene using S. aureus Cas9 selected according to third tier parameters. The targeting domains were selected within the remainder of the coding sequence downstream and contained a NNGRRT PAM. It is contemplated herein that the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase). In an embodiment, dual targeting is used to create two nicks on opposite DNA strands by using S. aureus Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp.

Table 26F of International PCT Pub. No. WO2015161276 provides targeting domains for knocking out the TRBC gene using N. meningitidis Cas9 selected according to first tier parameters. The targeting domains bind within the first 500 bp of coding sequence downstream of start codon and have good orthogonality. It is contemplated herein that the targeting domain hybridizes to the target domain through complementary base pairing. Any of the targeting domains in the table can be used with a N. meningitidis Cas9 molecule that generates a double stranded break (Cas9 nuclease) or a single-stranded break (Cas9 nickase). In an embodiment, dual targeting is used to create two nicks on opposite DNA strands by using N. meningitidis nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp.

Table 26G of International PCT Pub. No. WO2015161276 provides targeting domains for knocking out the TRBC gene using N. meningitides Cas9 selected according to second tier parameters. The targeting domains bind within the first 500 bp of coding sequence downstream of start codon and good orthogonality is not required. It is contemplated herein that the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase). In an embodiment, dual targeting is used to create two nicks on opposite DNA strands by using *N. meningitidis* Cas9 nickases with two targeting domains that are complementary to opposite DNA strands, e.g., a gRNA comprising any minus strand targeting domain may be paired with any gRNA comprising a plus strand targeting domain provided that the two gRNAs are oriented on the DNA such that PAMs face outward and the distance between the 5' ends of the gRNAs is 0-50 bp.

In some embodiments, the target sequence (target domain) is at or near the TRAC, TRBC1 and/or TRBC2 loci, such as any part of the TRAC, TRBC1 and/or TRBC2 coding sequence set forth in SEQ ID NOS: 348, 349 and 1047, respectively. In some embodiments, the target nucleic acid complementary to the targeting domain is located at an early coding region of a gene of interest, such as TRAC, TRBC1 and/or TRBC2. Targeting of the early coding region can be used to knockout (i.e., eliminate expression of) the gene of interest. In some embodiments, the early coding region of a gene of interest includes sequence immediately following a start codon (e.g., ATG), or within 500 bp of the start codon (e.g., less than 500, 450, 400, 350, 300, 250, 200, 150, 100, 50 bp, 40 bp, 30 bp, 20 bp, or 10 bp). In particular examples, the target nucleic acid is within 200 bp, 150 bp, 100 bp, 50 bp, 40 bp, 30 bp, 20 bp or 10 bp of the start codon. In some examples, the targeting domain of the gRNA is complementary, e.g., at least 80, 85, 90, 95, 98 or 99% complementary, e.g., fully complementary, to the target sequence on the target nucleic acid, such as the target nucleic acid in the TRAC, TRBC1 and/or TRBC2 loci.

In some embodiments, the genetic disruption, e.g., DNA break, is targeted at or in close proximity to the beginning of the coding region (e.g., the early coding region, e.g., within 500 bp from the start codon or the remaining coding sequence, e.g., downstream of the first 500 bp from the start codon). In some embodiments, the genetic disruption, e.g., DNA break, is targeted at early coding region of a gene of interest, e.g., TRAC, TRBC1 and/or TRBC2, including sequence immediately following a transcription start site, within a first exon of the coding sequence, or within 500 bp of the transcription start site (e.g., less than 500, 450, 400, 350, 300, 250, 200, 150, 100 or 50 bp), or within 500 bp of the start codon (e.g., less than 500, 450, 400, 350, 300, 250, 200, 150, 100 or 50 bp).

In some embodiments, the target site is within an exon of the endogenous TRAC, TRBC1, and/or TRBC2 locus. In certain embodiments, the target site is within an intron of the endogenous TRAC, TRBC1, and/or TRBC2 locus. In some aspects, the target site is within a regulatory or control element, e.g., a promoter, 5' untranslated region (UTR) or 3' UTR, of the TRAC, TRBC1, and/or TRBC2 locus. In certain embodiments, the target site is within an open reading frame of an endogenous TRAC, TRBC1, and/or TRBC2 locus. In particular embodiments, the target site is within an exon within the open reading frame of the TRAC, TRBC1, and/or TRBC2 locus.

In particular embodiments, the genetic disruption, e.g., DNA break, is targeted at or within an open reading frame of a gene or locus of interest, e.g., TRAC, TRBC1, and/or TRBC2. In some embodiments, the genetic disruption is targeted at or within an intron within the open reading frame of a gene or locus of interest. In some embodiments, the genetic disruption is targeted within an exon within the open reading frame of the gene or locus of interest.

In particular embodiments, a genetic disruption, e.g., DNA break, is targeted at or within an intron. In certain embodiments, a genetic disruption, e.g., DNA break, is targeted at or within an exon. In some embodiments, a genetic disruption, e.g., DNA break, is targeted at or within an exon of a gene of interest, e.g., TRAC, TRBC1 and/or TRBC2.

In some embodiments, a genetic disruption, e.g., DNA break, is targeted within an exon of the TRAC gene, open reading frame, or locus. In certain embodiments, the genetic disruption is within the first exon, second exon, third exon, or fourth exon of the TRAC gene, open reading frame, or locus. In particular embodiments, the genetic disruption is within the first exon of the TRAC gene, open reading frame, or locus. In some embodiments, the genetic disruption is within 500 base pairs (bp) downstream from the 5' end of the first exon in the TRAC gene, open reading frame, or locus. In particular embodiments, the genetic disruption is between the most 5' nucleotide of exon 1 and upstream of the most 3' nucleotide of exon 1. In certain embodiments, the genetic disruption is within 400 bp, 350 bp, 300 bp, 250 bp, 200 bp, 150 bp, 100 bp, or 50 bp downstream from the 5' end of the first exon in the TRAC gene, open reading frame, or locus. In particular embodiments, the genetic disruption is between 1 bp and 400 bp, between 50 and 300 bp, between 100 bp and 200 bp, or between 100 bp and 150 bp downstream from the 5' end of the first exon in the TRAC gene, open reading frame, or locus, each inclusive. In certain embodiments, the genetic disruption is between 100 bp and 150 bp downstream from the 5' end of the first exon in the TRAC gene, open reading frame, or locus, inclusive.

In particular embodiments, a genetic disruption, e.g., DNA break, is targeted within an exon of a TRBC gene, open reading frame, or locus, e.g., TRBC1 and/or the TRBC2. In certain embodiments, the genetic disruption is within the first exon, second exon, third exon, or fourth exon of the TRBC1 and/or the TRBC2 gene, open reading frame, or locus. In some embodiments, the genetic disruption is within the first exon of the TRBC1 and/or the TRBC2 gene, open reading frame, or locus. In certain embodiments, the genetic disruption is within the first exon, second exon, third exon, or fourth exon of the TRBC1 and/or the TRBC2 gene, open reading frame, or locus. In some embodiments, the genetic disruption is between the most 5' nucleotide of exon 1 and upstream of the most 3' nucleotide of exon 1. In particular embodiments, the genetic disruption is within the first exon of the TRBC gene, open reading frame, or locus. In some embodiments, the genetic disruption is within 400 bp, 350 bp, 300 bp, 250 bp, 200 bp, 150 bp, 100 bp, or 50 bp downstream from the 5' end of the first exon in a TRBC1 and/or the TRBC2 gene, open reading frame, or locus. In particular embodiments, the genetic disruption is between 1 bp and 400 bp, between 50 and 300 bp, between 100 bp and 200 bp, or between 100 bp and 150 bp downstream from the 5' end of the first exon in the TRBC1 and/or the TRBC2 gene, open reading frame, or locus, each inclusive. In certain embodiments, the genetic disruption is between 100 bp and 150 bp downstream from the 5' end of the first exon in the TRBC1 and/or the TRBC2 gene, open reading frame, or locus, inclusive.

In some embodiments, the targeting domain for knockout or knockdown of TRAC, TRBC1 and/or TRBC2 is or comprises a sequence selected from any of SEQ ID NOS: 1048, 1053, 1229-1315.

Exemplary targeting domains contained within the gRNA for targeting the genetic disruption of the human TRAC, TRBC1 or TRBC2 include those described in, e.g., WO2015/161276, WO2017/193107, WO2017/093969, US2016/272999 and US2015/056705 or a targeting domain that can bind to the targeting sequences described in the foregoing. Exemplary targeting domains contained within the gRNA for targeting the genetic disruption of the human TRAC locus using a Cas9 nuclease, such as a S. pyogenes or S. aureus Cas9, can include any of those set forth in Table 16 below.

TABLE 16

Exemplary TRAC gRNA targeting domain sequences

| gRNA Name | Targeting Domain | Cas9 species | SEQ ID NO: |
|---|---|---|---|
| TRAC-10 | UCUCUCAGCUGGUACACGGC | S. pyogenes | 1229 |
| TRAC-110 | UGGAUUUAGAGUCUCUCAGC | S. pyogenes | 1230 |
| TRAC-116 | ACACGGCAGGGUCAGGGUUC | S. pyogenes | 1231 |
| TRAC-16 | GAGAAUCAAAAUCGGUGAAU | S. pyogenes | 1048 |
| TRAC-4 | GCUGGUACACGGCAGGGUCA | S. pyogenes | 1232 |
| TRAC-49 | CUCAGCUGGUACACGGC | S. pyogenes | 1233 |
| TRAC-2 | UGGUACACGGCAGGGUC | S. pyogenes | 1234 |
| TRAC-30 | GCUAGACAUGAGGUCUA | S. pyogenes | 1235 |
| TRAC-43 | GUCAGAUUUGUUGCUCC | S. pyogenes | 1236 |
| TRAC-23 | UCAGCUGGUACACGGCA | S. pyogenes | 1237 |
| TRAC-34 | GCAGACAGACUUGUCAC | S. pyogenes | 1238 |
| TRAC-25 | GGUACACGGCAGGGUCA | S. pyogenes | 1239 |
| TRAC-128 | CUUCAAGAGCAACAGUGCUG | S. pyogenes | 1240 |
| TRAC-105 | AGAGCAACAGUGCUGUGGCC | S. pyogenes | 1241 |
| TRAC-106 | AAAGUCAGAUUUGUUGCUCC | S. pyogenes | 1242 |
| TRAC-123 | ACAAAACUGUGCUAGACAUG | S. pyogenes | 1243 |
| TRAC-64 | AAACUGUGCUAGACAUG | S. pyogenes | 1244 |
| TRAC-97 | UGUGCUAGACAUGAGGUCUA | S. pyogenes | 1245 |
| TRAC-148 | GGCUGGGGAAGAAGGUGUCUUC | S. aureus | 1246 |
| TRAC-147 | GCUGGGGAAGAAGGUGUCUUC | S. aureus | 1247 |
| TRAC-234 | GGGGAAGAAGGUGUCUUC | S. aureus | 1248 |
| TRAC-167 | GUUUUGUCUGUGAUAUACACAU | S. aureus | 1249 |
| TRAC-177 | GGCAGACAGACUUGUCACUGGAUU | S. aureus | 1250 |
| TRAC-176 | GCAGACAGACUUGUCACUGGAUU | S. aureus | 1251 |
| TRAC-257 | GACAGACUUGUCACUGGAUU | S. aureus | 1252 |
| TRAC-233 | GUGAAUAGGCAGACAGACUUGUCA | S. aureus | 1253 |
| TRAC-231 | GAAUAGGCAGACAGACUUGUCA | S. aureus | 1254 |
| TRAC-163 | GAGUCUCUCAGCUGGUACACGG | S. aureus | 1255 |
| TRAC-241 | GUCUCUCAGCUGGUACACGG | S. aureus | 1256 |
| TRAC-179 | GGUACACGGCAGGGUCAGGGUU | S. aureus | 1257 |
| TRAC-178 | GUACACGGCAGGGUCAGGGUU | S. aureus | 1258 |

Exemplary targeting domains contained within the gRNA for targeting the genetic disruption of the human TRBC1 or TRBC2 locus using a Cas9 nuclease, such as S. pyogenes or S. aureus Cas9, can include any of those set forth in Table 17 below.

TABLE 17

Exemplary TRBC1 or TRBC2 gRNA targeting domain sequences

| gRNA Name | Targeting Domain | Cas9 species | SEQ ID NO: |
|---|---|---|---|
| TRBC-40 | CACCCAGAUCGUCAGCGCCG | S. pyogenes | 1259 |
| TRBC-52 | CAAACACAGCGACCUCGGGU | S. pyogenes | 1260 |
| TRBC-25 | UGACGAGUGGACCCAGGAUA | S. pyogenes | 1261 |
| TRBC-35 | GGCUCUCGGAGAAUGACGAG | S. pyogenes | 1262 |
| TRBC-50 | GGCCUCGGCGCUGACGAUCU | S. pyogenes | 1053 |
| TRBC-39 | GAAAAACGUGUUCCCACCCG | S. pyogenes | 1263 |
| TRBC-49 | AUGACGAGUGGACCCAGGAU | S. pyogenes | 1264 |
| TRBC-51 | AGUCCAGUUCUACGGGCUCU | S. pyogenes | 1265 |
| TRBC-26 | CGCUGUCAAGUCCAGUUCUA | S. pyogenes | 1266 |
| TRBC-47 | AUCGUCAGCGCCGAGGCCUG | S. pyogenes | 1267 |
| TRBC-45 | UCAAACACAGCGACCUCGGG | S. pyogenes | 1268 |
| TRBC-34 | CGUAGAACUGGACUUGACAG | S. pyogenes | 1269 |
| TRBC-227 | AGGCCUCGGCGCUGACGAUC | S. pyogenes | 1270 |
| TRBC-41 | UGACAGCGGAAGUGGUUGCG | S. pyogenes | 1271 |
| TRBC-30 | UUGACAGCGGAAGUGGUUGC | S. pyogenes | 1272 |
| TRBC-206 | UCUCCGAGAGCCCGUAGAAC | S. pyogenes | 1273 |
| TRBC-32 | CGGGUGGGAACACGUUUUUC | S. pyogenes | 1274 |
| TRBC-276 | GACAGGUUUGGCCCUAUCCU | S. pyogenes | 1275 |
| TRBC-274 | GAUCGUCAGCGCCGAGGCCU | S. pyogenes | 1276 |
| TRBC-230 | GGCUCAAACACAGCGACCUC | S. pyogenes | 1277 |
| TRBC-235 | UGAGGGUCUCGGCCACCUUC | S. pyogenes | 1278 |
| TRBC-38 | AGGCUUCUACCCCGACCACG | S. pyogenes | 1279 |
| TRBC-223 | CCGACCACGUGGAGCUGAGC | S. pyogenes | 1280 |

TABLE 17-continued

Exemplary TRBC1 or TRBC2 gRNA targeting domain sequences

| gRNA Name | Targeting Domain | Cas9 species | SEQ ID NO: |
|---|---|---|---|
| TRBC-221 | UGACAGGUUUGGCCCUAUCC | S. pyogenes | 1281 |
| TRBC-48 | CUUGACAGCGGAAGUGGUUG | S. pyogenes | 1282 |
| TRBC-216 | AGAUCGUCAGCGCCGAGGCC | S. pyogenes | 1283 |
| TRBC-210 | GCGCUGACGAUCUGGGUGAC | S. pyogenes | 1284 |
| TRBC-268 | UGAGGGCGGGCUGCUCCUUG | S. pyogenes | 1285 |
| TRBC-193 | GUUGCGGGGGUUCUGCCAGA | S. pyogenes | 1286 |
| TRBC-246 | AGCUCAGCUCCACGUGGUCG | S. pyogenes | 1287 |
| TRBC-228 | GCGGCUGCUCAGGCAGUAUC | S. pyogenes | 1288 |
| TRBC-43 | GCGGGGGUUCUGCCAGAAGG | S. pyogenes | 1289 |
| TRBC-272 | UGGCUCAAACACAGCGACCU | S. pyogenes | 1290 |
| TRBC-33 | ACUGGACUUGACAGCGGAAG | S. pyogenes | 1291 |
| TRBC-44 | GACAGCGGAAGUGGUUGCGG | S. pyogenes | 1292 |
| TRBC-211 | GCUGUCAAGUCCAGUUCUAC | S. pyogenes | 1293 |
| TRBC-253 | GUAUCUGGAGUCAUUGAGGG | S. pyogenes | 1294 |
| TRBC-18 | CUCGGCGCUGACGAUCU | S. pyogenes | 1295 |
| TRBC-6 | CCUCGGCGCUGACGAUC | S. pyogenes | 1296 |
| TRBC-85 | CCGAGAGCCCGUAGAAC | S. pyogenes | 1297 |
| TRBC-129 | CCAGAUCGUCAGCGCCG | S. pyogenes | 1298 |
| TRBC-93 | GAAUGACGAGUGGACCC | S. pyogenes | 1299 |
| TRBC-415 | GGGUGACAGGUUUGGCCCUAUC | S. aureus | 1300 |
| TRBC-414 | GGUGACAGGUUUGGCCCUAUC | S. aureus | 1301 |
| TRBC-310 | GUGACAGGUUUGGCCCUAUC | S. aureus | 1302 |
| TRBC-308 | GACAGGUUUGGCCCUAUC | S. aureus | 1303 |
| TRBC-401 | GAUACUGCCUGAGCAGCCGCCU | S. aureus | 1304 |
| TRBC-468 | GACCACGUGGAGCUGAGCUGGUGG | S. aureus | 1305 |
| TRBC-462 | GUGGAGCUGAGCUGGUGG | S. aureus | 1306 |
| TRBC-424 | GGGCGGGCUGCUCCUUGAGGGGCU | S. aureus | 1307 |
| TRBC-423 | GGCGGGCUGCUCCUUGAGGGGCU | S. aureus | 1308 |
| TRBC-422 | GCGGGCUGCUCCUUGAGGGGCU | S. aureus | 1309 |
| TRBC-420 | GGGCUGCUCCUUGAGGGGCU | S. aureus | 1310 |
| TRBC-419 | GGCUGCUCCUUGAGGGGCU | S. aureus | 1311 |
| TRBC-418 | GCUGCUCCUUGAGGGGCU | S. aureus | 1312 |
| TRBC-445 | GGUGAAUGGGAAGGAGGUGCACAG | S. aureus | 1313 |
| TRBC-444 | GUGAAUGGGAAGGAGGUGCACAG | S. aureus | 1314 |
| TRBC-442 | GAAUGGGAAGGAGGUGCACAG | S. aureus | 1315 |

In some embodiments, the gRNA for targeting TRAC, TRBC1 and/or TRBC2 can be any that are described herein, or are described elsewhere, e.g., in WO2015/161276, WO2017/193107, WO2017/093969, US2016/272999 and US2015/056705 or a targeting domain that can bind to the targeting sequences described in the foregoing. In some embodiments, the sequence targeted by the CRISPR/Cas9 gRNA in the TRAC gene locus is GAGAAT-CAAAATCGGTGAAT (SEQ ID NO: 1348) or ATTCACC-GATTTTGATTCTC (SEQ ID NO:1182). In some embodiments, the sequence targeted by the CRISPR/Cas9 gRNA in the TRBC1 and/or TRBC2 gene loci is GGCCTCGGCGCTGACGATCT (SEQ ID NO: 1349) or AGATCGTCAGCGCCGAGGCC (SEQ ID NO:1054). In some embodiments, the gRNA targeting domain sequence for targeting a target site in the TRAC gene locus is GAGAAUCAAAAUCGGUGAAU (SEQ ID NO: 1048). In some embodiments, the gRNA targeting domain sequence for targeting a target site in the TRBC1 and/or TRBC2 gene loci is GGCCUCGGCGCUGACGAUCU (SEQ ID NO: 1053).

In some embodiments, the gRNA for targeting the TRAC gene locus can be obtained by in vitro transcription of the sequence

AGCGCTCTCGTACAGAGTTGGCATTATAATACGACTCACTATAGGGGAGA

ATCAAAATCGGTGAATGTTTTAGAGCTAGAAATAGCAAGTTAAAATAAGG

CTAGTCCGTTATCAACTTGAAAAAGTGGCACCGAGTCGGTGCTTTTTT (set forth in SEQ ID NO: 1350; bold and underlined portion is complementary to the target site in the TRAC locus), or chemically synthesized, where the gRNA had the sequence 5'-

5'-GAG AAU CAA AAU CGG UGA AUG UUU UAG AGC UAG AAA

UAG CAA GUU AAA AUA AGG CUA GUC CGU UAU CAA CUU

GAA AAA GUG GCA CCG AGU CGG UGC UUU U-3'

(set forth in SEQ ID NO: 1351; see Osborn et al., Mol Ther. 24(3):570-581 (2016)). Other exemplary gRNA sequences, or targeting domains contained in the gRNA and/or other methods of gene editing and/or knock-out targeting endogenous TCR genes, e.g., TRAC and/or TRBC genes, include any described in, e.g. U.S. Publication Nos. US2011/0158957, US2014/0301990, US2015/0098954, US2016/0208243; US2016/272999 and US2015/056705; International PCT Publication Nos. WO2014/191128, WO2015/136001, WO2015/161276, WO2016/069283, WO2016/016341, WO2017/193107, and WO2017/093969; and Osborn et al. (2016) Mol. Ther. 24(3):570-581. Any of the known methods can be used to generate a cleavage of the endogenous genes encoding TCR domains or regions can be used in the embodiments provided herein, e.g., for engineering in cell lines and/or in primary T cells.

In some embodiments, targeting domains include those for knocking out the TRAC, TRBC1 and/or TRBC2 genes using S. pyogenes Cas9, S. aureus Cas9 or using N. meningitidis Cas9.

In some embodiments, targeting domains include those for knocking out the TRAC, TRBC1 and/or TRBC2 genes using *S. pyogenes* Cas9. Any of the targeting domains can be used with a *S. pyogenes* Cas9 molecule that generates a double stranded break (Cas9 nuclease) or a single-stranded break (Cas9 nickase).

In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired with any gRNA comprising a plus strand targeting domain. In some embodiments, the two gRNAs are oriented on the DNA such that PAMs face outward and the distance between the 5' ends of the gRNAs is 0-50 bp. In an embodiment, two gRNAs are used to target two Cas9 nucleases or two Cas9 nickases, for example, using a pair of Cas9 molecule/gRNA molecule complex guided by two different gRNA molecules to cleave the target domain with two single stranded breaks on opposing strands of the target domain. In some embodiments, the two Cas9 nickases can include a molecule having HNH activity, e.g., a Cas9 molecule having the RuvC activity inactivated, e.g., a Cas9 molecule having a mutation at D10, e.g., the D10A mutation, a molecule having RuvC activity, e.g., a Cas9 molecule having the HNH activity inactivated, e.g., a Cas9 molecule having a mutation at H840, e.g., a H840A, or a molecule having RuvC activity, e.g., a Cas9 molecule having the HNH activity inactivated, e.g., a Cas9 molecule having a mutation at N863, e.g., N863A. In some embodiments, each of the two gRNAs are complexed with a D10A Cas9 nickase.

(3) The First Complementarity Domain

FIGS. 14A-14G provide examples of first complementarity domains. The first complementarity domain is complementary with the second complementarity domain described below, and generally has sufficient complementarity to the second complementarity domain to form a duplexed region under at least some physiological conditions. The first complementarity domain is typically 5 to 30 nucleotides in length, and may be 5 to 25 nucleotides in length, 7 to 25 nucleotides in length, 7 to 22 nucleotides in length, 7 to 18 nucleotides in length, or 7 to 15 nucleotides in length. In various embodiments, the first complementary domain is 5, 6, 7, 8, 9, 10, 11, 12, 13, 14, 15, 16, 17, 18, 19, 20, 21, 22, 23, 24, or 25 nucleotides in length.

Typically, the first complementarity domain does not have exact complementarity with the second complementarity domain target. In some embodiments, the first complementarity domain can have 1, 2, 3, 4 or 5 nucleotides that are not complementary with the corresponding nucleotide of the second complementarity domain. For instance, a segment of 1, 2, 3, 4, 5 or 6, (e.g., 3) nucleotides of the first complementarity domain may not pair in the duplex, and may form a non-duplexed or looped-out region. In some instances, an unpaired, or loop-out, region, e.g., a loop-out of 3 nucleotides, is present on the second complementarity domain. This unpaired region optionally begins 1, 2, 3, 4, 5, or 6, e.g., 4, nucleotides from the 5' end of the second complementarity domain.

The first complementarity domain can include 3 subdomains, which, in the 5' to 3' direction are: a 5' subdomain, a central subdomain, and a 3' subdomain. In an embodiment, the 5' subdomain is 4-9, e.g., 4, 5, 6, 7, 8 or 9 nucleotides in length. In an embodiment, the central subdomain is 1, 2, or 3, e.g., 1, nucleotide in length. In an embodiment, the 3' subdomain is 3 to 25, e.g., 4-22, 4-18, or 4 to 10, or 3, 4, 5, 6, 7, 8, 9, 10, 11, 12, 13, 14, 15, 16, 17, 18, 19, 20, 21, 22, 23, 24, or 25, nucleotides in length.

In some embodiments, the first and second complementarity domains, when duplexed, comprise 11 paired nucleotides, for example, in the gRNA sequence (one paired strand underlined, one bolded):

(SEQ ID NO: 1316)
NNNNNNNNNNNNNNNNNNNNNNGUUUUAGAGCUAGAAAUAGCAAGUUAAAAU

AAGGCUAGUCCGUUAUCAACUUGAAAAAGUGGCACCGAGUCGGUGC.

In some embodiments, the first and second complementarity domains, when duplexed, comprise 15 paired nucleotides, for example in the gRNA sequence (one paired strand underlined, one bolded):

(SEQ ID NO: 1317)
NNNNNNNNNNNNNNNNNNNNNNGUUUUAGAGCUAUGCUGAAAAGCAUAGCAA

GUUAAAAUAAGGCUAGUCCGUUAUCAACUUGAAAAAGUGGCACCGAGUCG

GUGC.

In some embodiments the first and second complementarity domains, when duplexed, comprise 16 paired nucleotides, for example in the gRNA sequence (one paired strand underlined, one bolded):

(SEQ ID NO: 1318)
NNNNNNNNNNNNNNNNNNNNNNGUUUUAGAGCUAUGCUGGAAACAGCAUAGC

AAGUUAAAAUAAGGCUAGUCCGUUAUCAACUUGAAAAAGUGGCACCGAGU

CGGUGC.

In some embodiments, the first and second complementarity domains, when duplexed, comprise 21 paired nucleotides, for example in the gRNA sequence (one paired strand underlined, one bolded):

(SEQ ID NO: 1319)
NNNNNNNNNNNNNNNNNNNNNNGUUUUAGAGCUAUGCUGUUUUGGAAACAAA

ACAGCAUAGCAAGUUAAAAUAAGGCUAGUCCGUUAUCAACUUGAAAAAGU

GGCACCGAGUCGGUGC.

In some embodiments, nucleotides are exchanged to remove poly-U tracts, for example in the gRNA sequences (exchanged nucleotides underlined):

(SEQ ID NO: 1320)
NNNNNNNNNNNNNNNNNNNNNNGUAUUAGAGCUAGAAAUAGCAAGUUAAUAU

AAGGCUAGUCCGUUAUCAACUUGAAAAAGUGGCACCGAGUCGGUGC;

(SEQ ID NO: 1321)
NNNNNNNNNNNNNNNNNNNNNNGUUUAAGAGCUAGAAAUAGCAAGUUUAAAU

AAGGCUAGUCCGUUAUCAACUUGAAAAAGUGGCACCGAGUCGGUGC;
and (SEQ ID NO: 1322)
NNNNNNNNNNNNNNNNNNNNNNGUAUUAGAGCUAUGCUGUAUUGGAAACAAU

ACAGCAUAGCAAGUUAAUAUAAGGCUAGUCCGUUAUCAACUUGAAAAAGU

GGCACCGAGUCGGUGC.

The first complementarity domain can share homology with, or be derived from, a naturally occurring first complementarity domain. In an embodiment, it has at least 50% homology with a first complementarity domain disclosed herein, e.g., an S. pyogenes, S. aureus, N. meningtidis, or S. thermophilus, first complementarity domain.

It should be noted that one or more, or even all of the nucleotides of the first complementarity domain, can have a modification along the lines discussed above for the targeting domain.

(4) The Linking Domain

FIGS. 14A-14G provide examples of linking domains.

In a unimolecular or chimeric gRNA, the linking domain serves to link the first complementarity domain with the second complementarity domain of a unimolecular gRNA. The linking domain can link the first and second complementarity domains covalently or non-covalently. In an embodiment, the linkage is covalent. In an embodiment, the linking domain covalently couples the first and second complementarity domains, see, e.g., FIGS. 14B-14E. In an embodiment, the linking domain is, or comprises, a covalent bond interposed between the first complementarity domain and the second complementarity domain. Typically the linking domain comprises one or more, e.g., 2, 3, 4, 5, 6, 7, 8, 9, or 10 nucleotides, but in various embodiments the linker can be 20, 30, 40, 50 or even 100 nucleotides in length.

In modular gRNA molecules, the two molecules are associated by virtue of the hybridization of the complementarity domains and a linking domain may not be present. See e.g., FIG. 14A.

A wide variety of linking domains are suitable for use in unimolecular gRNA molecules. Linking domains can consist of a covalent bond, or be as short as one or a few nucleotides, e.g., 1, 2, 3, 4, or 5 nucleotides in length. In an embodiment, a linking domain is 2, 3, 4, 5, 6, 7, 8, 9, 10, 15, 20, or 25 or more nucleotides in length. In an embodiment, a linking domain is 2 to 50, 2 to 40, 2 to 30, 2 to 20, 2 to 10, or 2 to 5 nucleotides in length. In an embodiment, a linking domain shares homology with, or is derived from, a naturally occurring sequence, e.g., the sequence of a tracrRNA that is 5' to the second complementarity domain. In an embodiment, the linking domain has at least 50% homology with a linking domain disclosed herein.

As discussed above in connection with the first complementarity domain, some or all of the nucleotides of the linking domain can include a modification.

(5) The 5' Extension Domain

Figure 14A:
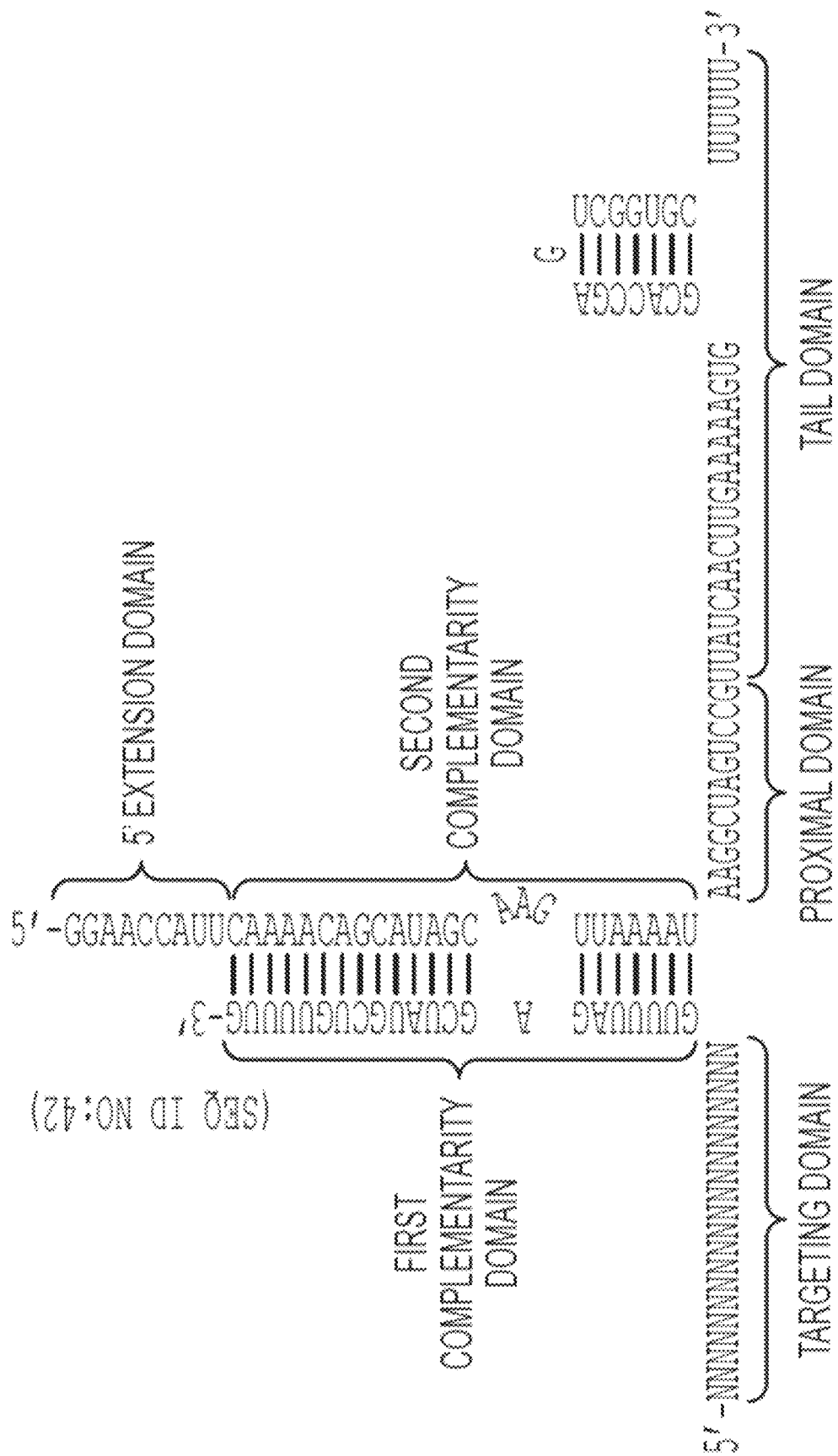

In some cases, a modular gRNA can comprise additional sequence, 5' to the second complementarity domain, referred to herein as the 5' extension domain, see, e.g., FIG. 14A. In an embodiment, the 5' extension domain is, 2-10, 2-9, 2-8, 2-7, 2-6, 2-5, or 2-4 nucleotides in length. In an embodiment, the 5' extension domain is 2, 3, 4, 5, 6, 7, 8, 9, or 10 or more nucleotides in length.

(6) The Second Complementarity Domain

Figure 14B:
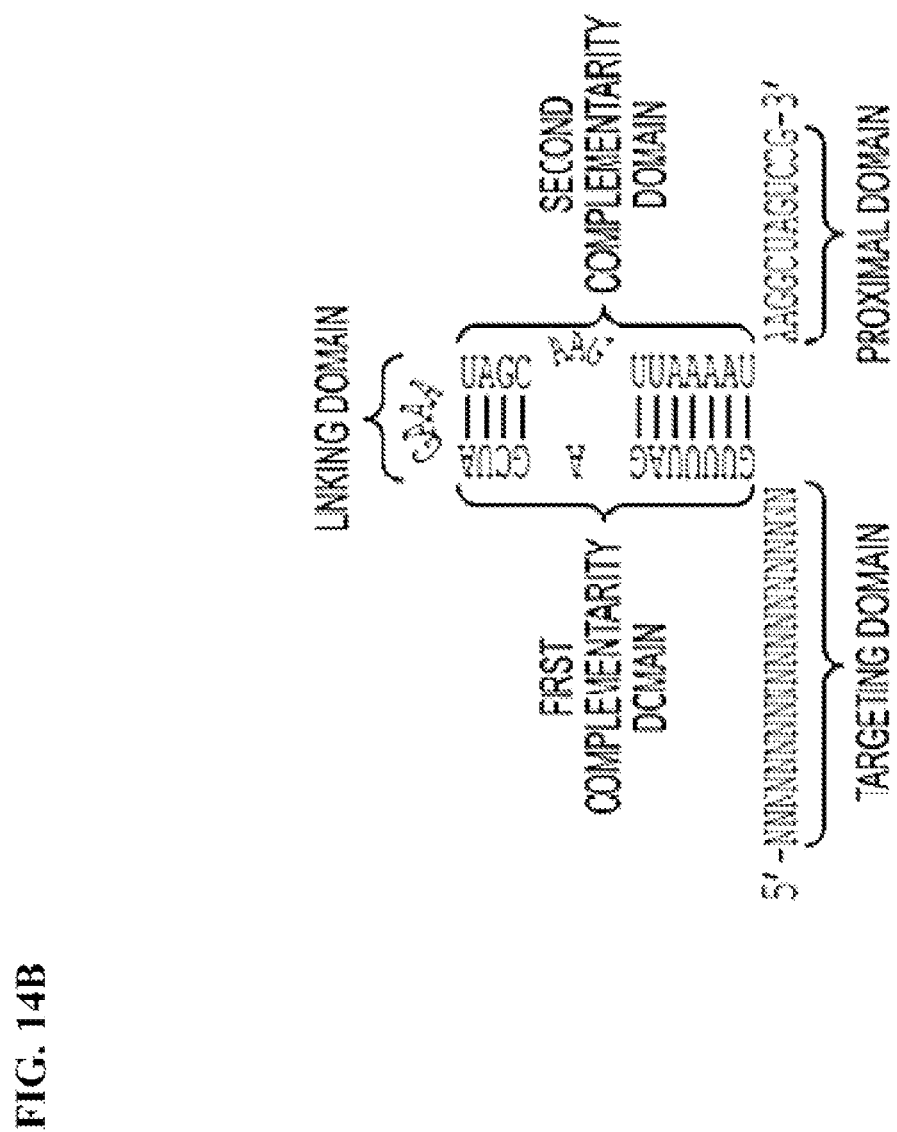
Figure 14C:
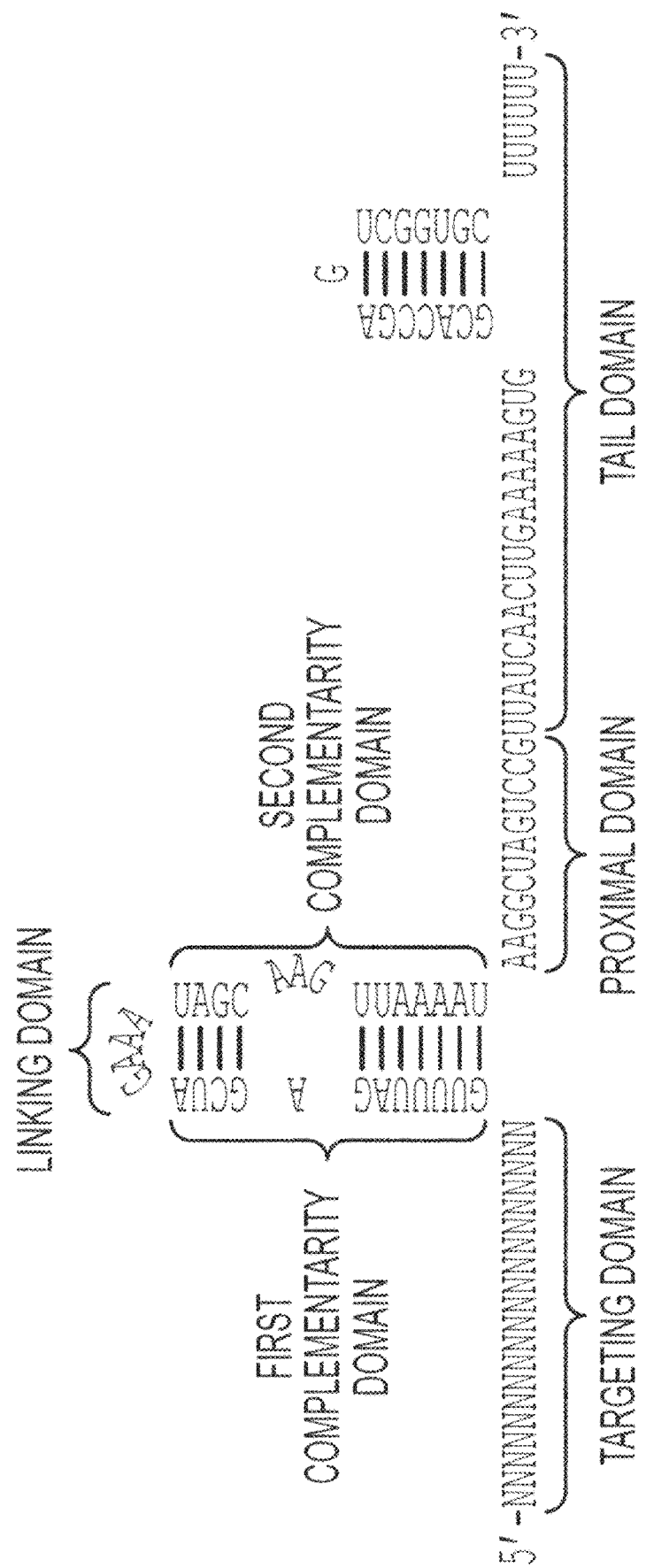
Figure 14D:
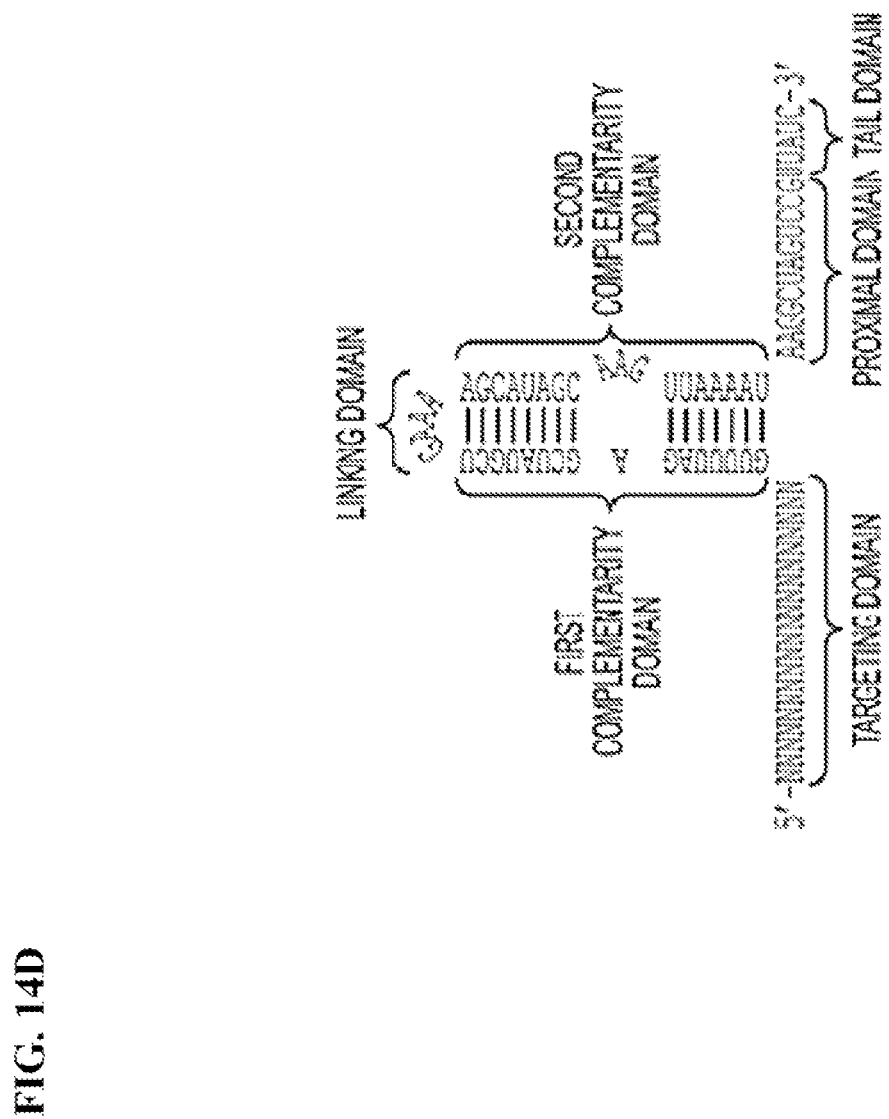
Figure 14E:
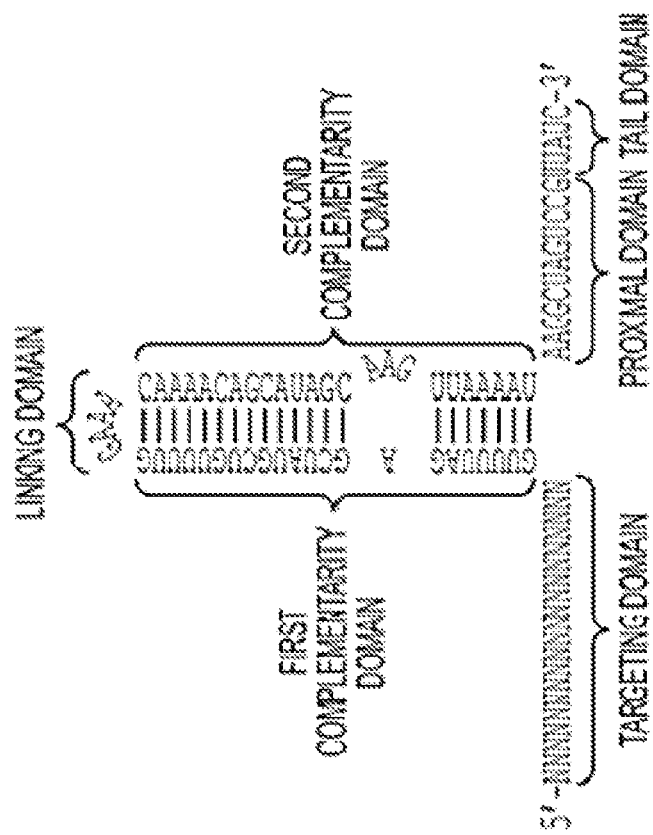
Figure 15A:
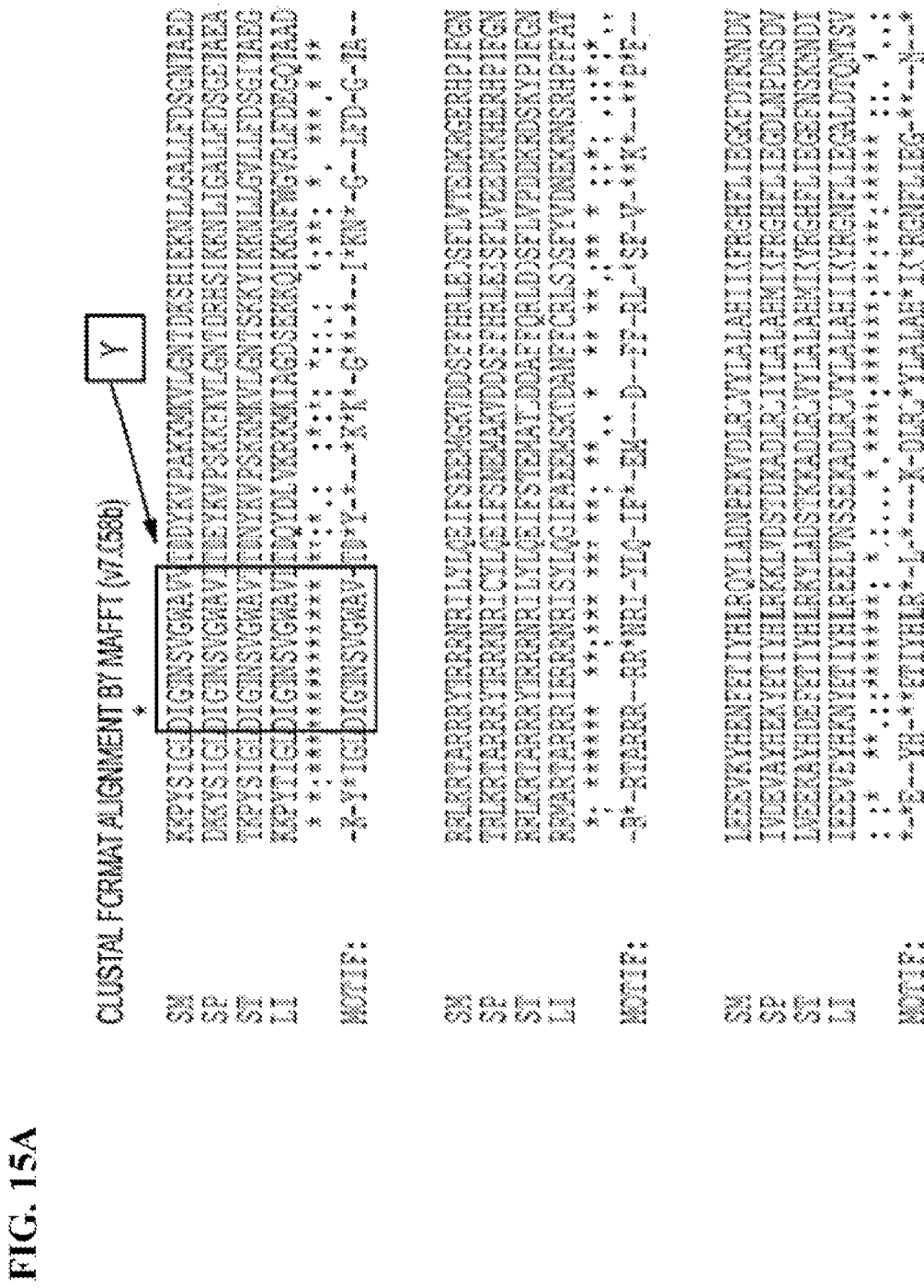
Figure 15B:
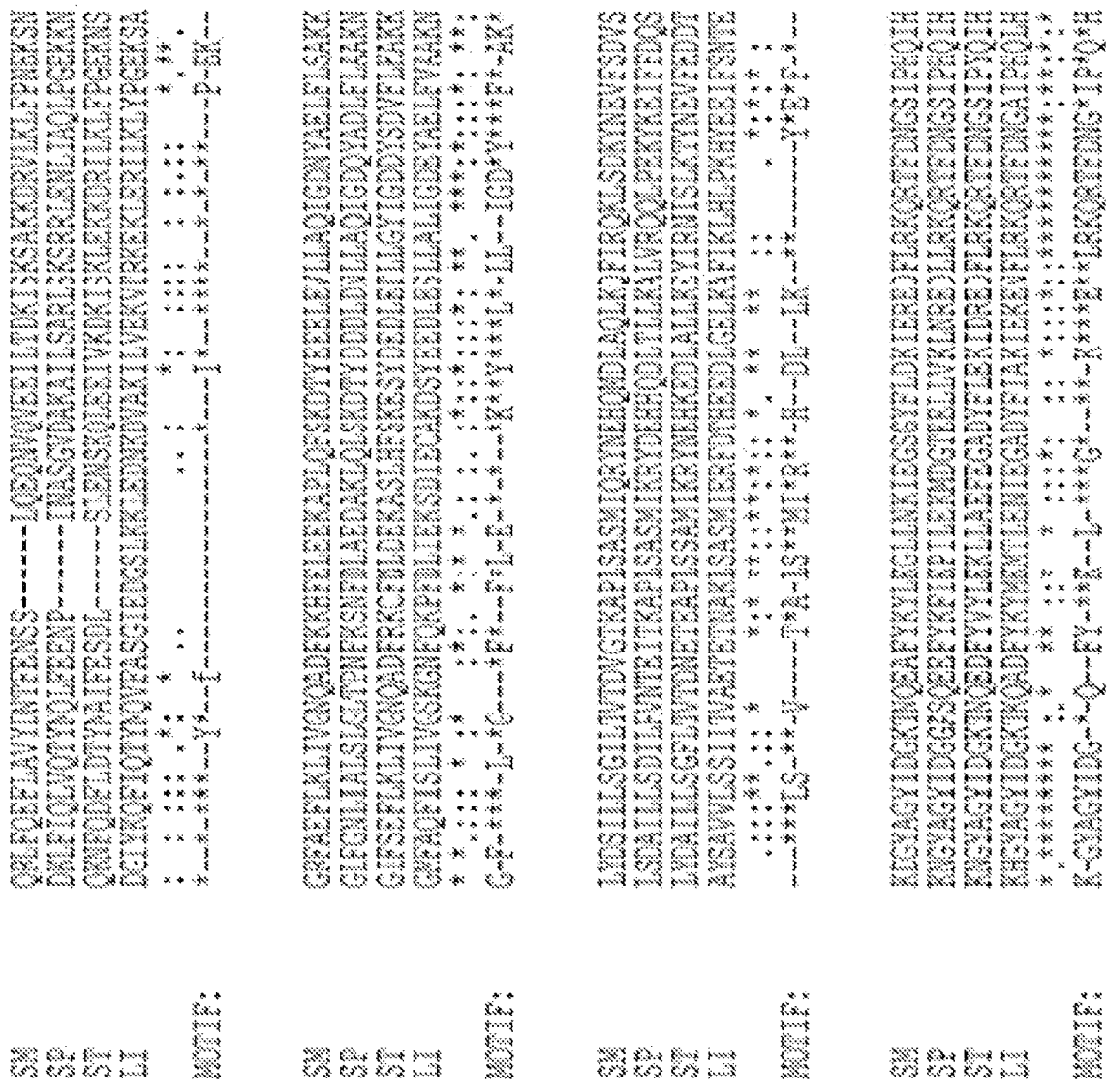
Figure 15D:
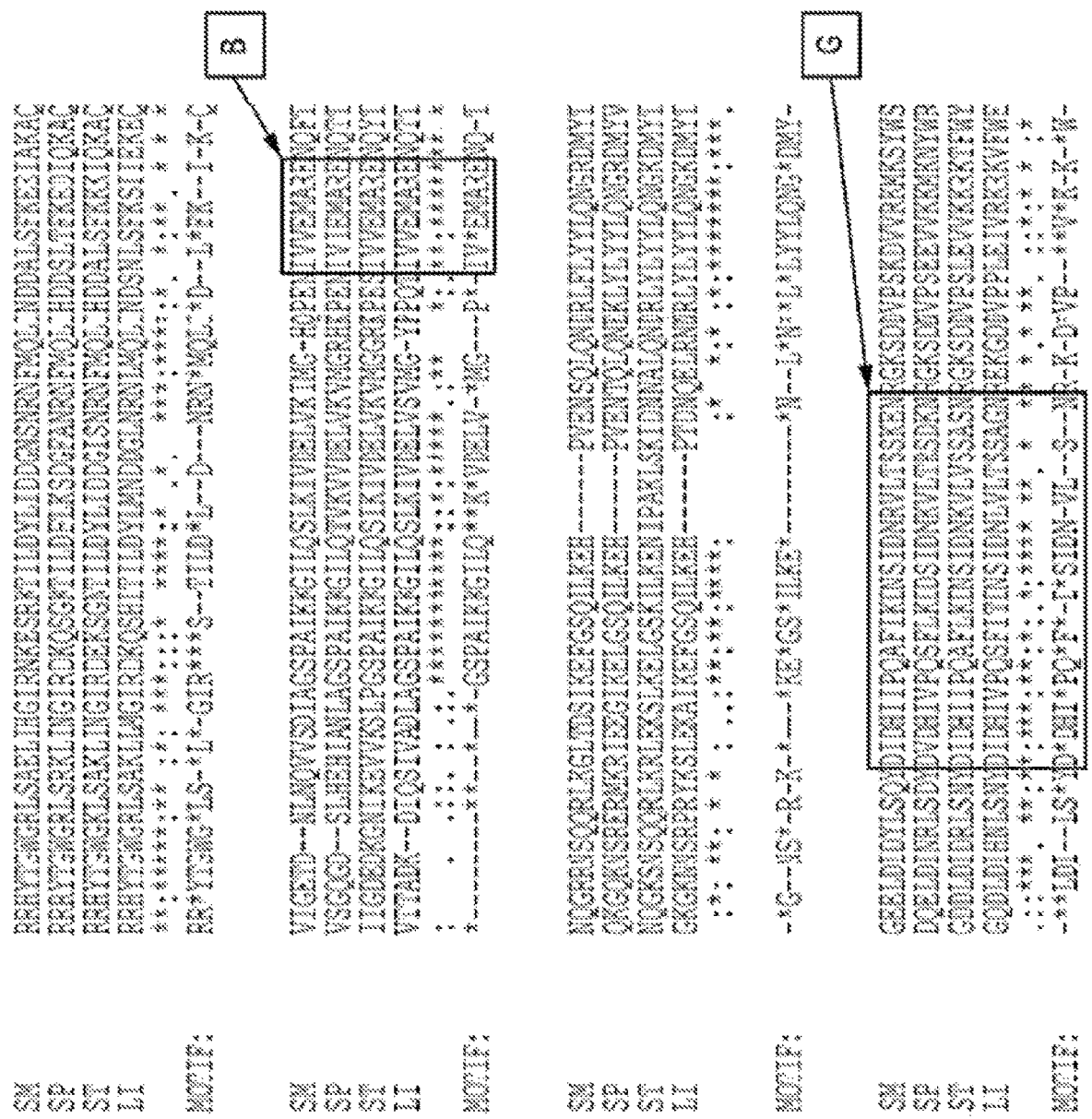
Figure 15E:
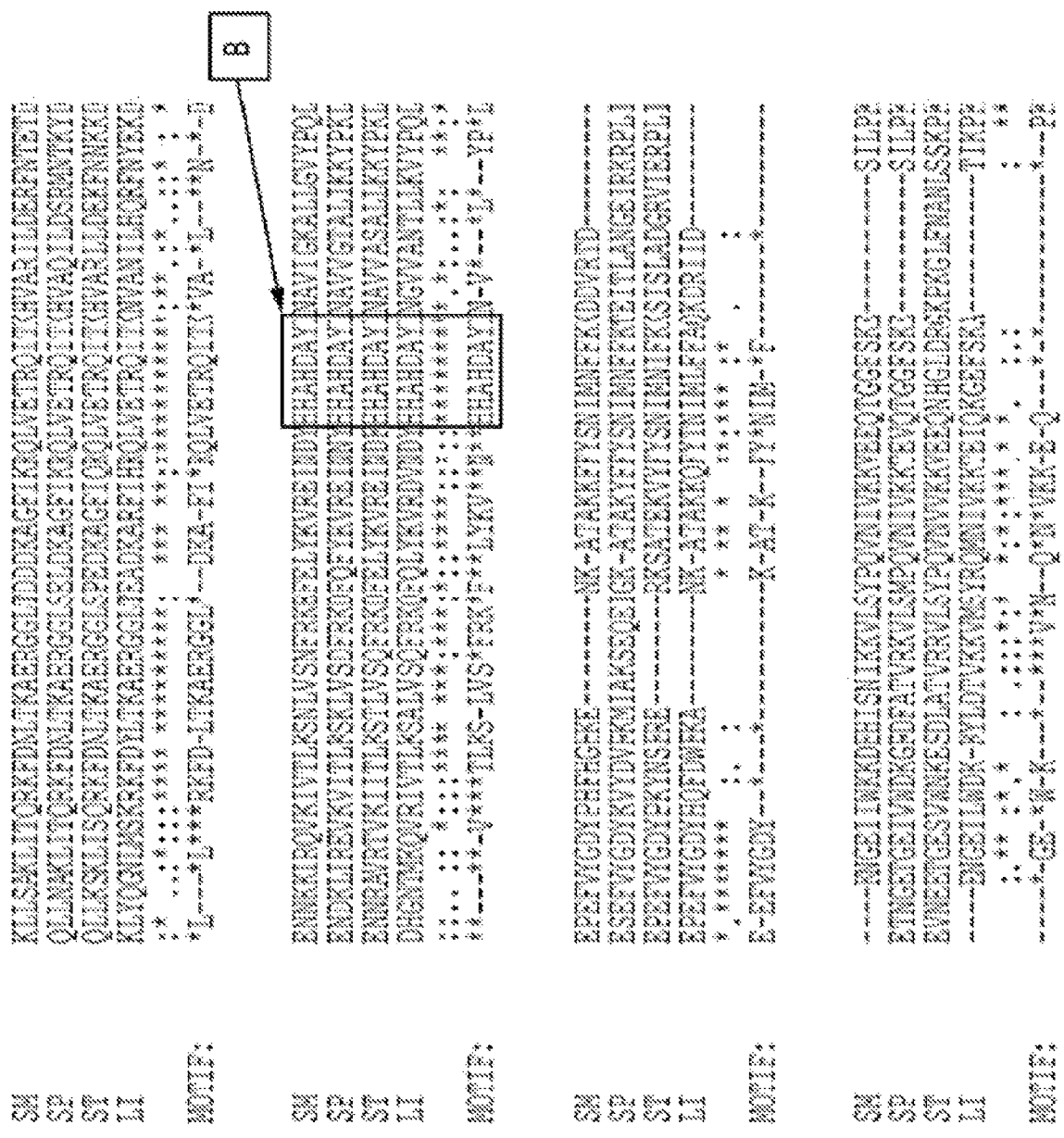
Figure 15F:
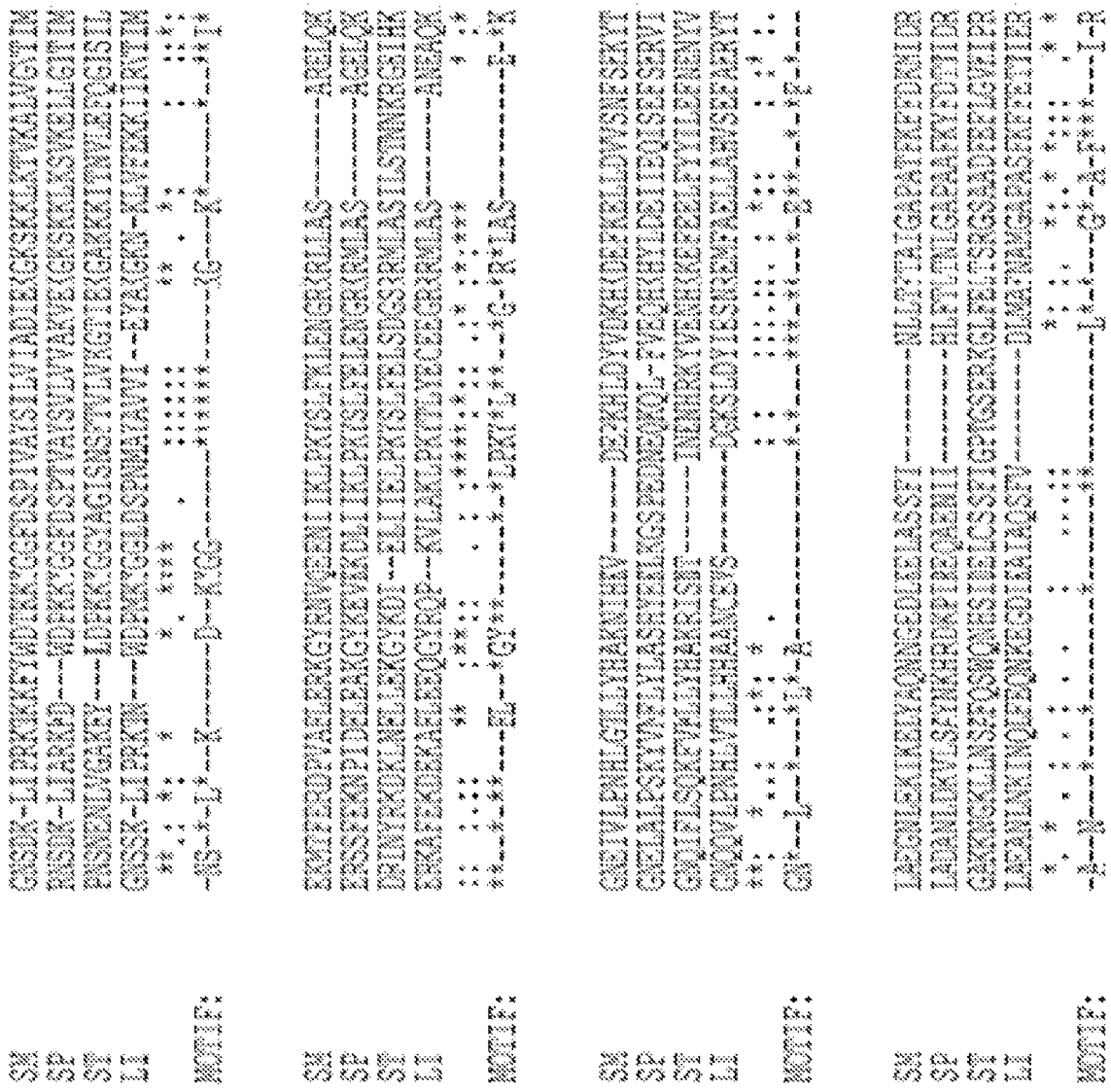
Figure 15G:

FIGS. 14A-14G provide examples of second complementarity domains. The second complementarity domain is complementary with the first complementarity domain, and generally has sufficient complementarity to the second complementarity domain to form a duplexed region under at least some physiological conditions. In some cases, e.g., as shown in FIGS. 14A-14B, the second complementarity domain can include sequence that lacks complementarity with the first complementarity domain, e.g., sequence that loops out from the duplexed region.

The second complementarity domain may be 5 to 27 nucleotides in length, and in some cases may be longer than the first complementarity region. For instance, the second complementarity domain can be 7 to 27 nucleotides in length, 7 to 25 nucleotides in length, 7 to 20 nucleotides in length, or 7 to 17 nucleotides in length. More generally, the complementary domain may be 5, 6, 7, 8, 9, 10, 11, 12, 13, 14, 15, 16, 17, 18, 19, 20, 21, 22, 23, 24, 25, or 26 nucleotides in length.

In an embodiment, the second complementarity domain comprises 3 subdomains, which, in the 5' to 3' direction are: a 5' subdomain, a central subdomain, and a 3' subdomain. In an embodiment, the 5' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length. In an embodiment, the central subdomain is 1, 2, 3, 4 or 5, e.g., 3, nucleotides in length. In an embodiment, the 3' subdomain is 4 to 9, e.g., 4, 5, 6, 7, 8 or 9 nucleotides in length.

In an embodiment, the 5' subdomain and the 3' subdomain of the first complementarity domain, are respectively, complementary, e.g., fully complementary, with the 3' subdomain and the 5' subdomain of the second complementarity domain.

The second complementarity domain can share homology with or be derived from a naturally occurring second complementarity domain. In an embodiment, it has at least 50% homology with a second complementarity domain disclosed herein, e.g., an S. pyogenes, S. aureus, N. meningtidis, or S. thermophilus, first complementarity domain.

Some or all of the nucleotides of the second complementarity domain can have a modification, e.g., a modification found in Section VIII herein.

(7) The Proximal Domain

FIGS. 14A-14G provide examples of proximal domains

In an embodiment, the proximal domain is 5 to 20 nucleotides in length. In an embodiment, the proximal domain can share homology with or be derived from a naturally occurring proximal domain. In an embodiment, it has at least 50% homology with a proximal domain disclosed herein, e.g., an S. pyogenes, S. aureus, N. meningtidis, or S. thermophilus, proximal domain.

Some or all of the nucleotides of the proximal domain can have a modification along the lines described above.

(8) The Tail Domain

FIGS. 14A-14G provide examples of tail domains.

As can be seen by inspection of the tail domains in FIG. 14A and FIGS. 14B-14F, a broad spectrum of tail domains are suitable for use in gRNA molecules. In various embodiments, the tail domain is 0 (absent), 1, 2, 3, 4, 5, 6, 7, 8, 9, or 10 nucleotides in length. In certain embodiments, the tail domain nucleotides are from or share homology with sequence from the 5' end of a naturally occurring tail domain, see e.g., FIG. 14D or 14E. The tail domain also optionally includes sequences that are complementary to each other and which, under at least some physiological conditions, form a duplexed region.

Tail domains can share homology with or be derived from naturally occurring proximal tail domains By way of non-limiting example, a given tail domain according to various embodiments of the present disclosure may share at least 50% homology with a naturally occurring tail domain disclosed herein, e.g., an S. pyogenes, S. aureus, N. meningtidis, or S. thermophilus, tail domain.

In certain cases, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When alternate pol-III promoters are used, these nucleotides may be various numbers or uracil bases or may include alternate bases.

As a non-limiting example, in various embodiments the proximal and tail domain, taken together comprise the following sequences:

AAGGCUAGUCCGUUAUCAACUUGAAAAAGUGGCACCGAGUCGGUGCU, (SEQ ID NO: 1323)

AAGGCUAGUCCGUUAUCAACUUGAAAAAGUGGCACCGAGUCGGUGGUGC, (SEQ ID NO: 1324)

AAGGCUAGUCCGUUAUCAACUUGAAAAAGUGGCACCGAGUCGGUGCGGA UC, (SEQ ID NO: 1325)

AAGGCUAGUCCGUUAUCAACUUGAAAAAGUG, (SEQ ID NO: 1326)

AAGGCUAGUCCGUUAUCA, (SEQ ID NO: 1327)
or

AAGGCUAGUCCG. (SEQ ID NO: 1328)

In an embodiment, the tail domain comprises the 3' sequence UUUUUU, e.g., if a U6 promoter is used for transcription.

In an embodiment, the tail domain comprises the 3' sequence UUUU, e.g., if an H1 promoter is used for transcription.

In an embodiment, tail domain comprises variable numbers of 3' Us depending, e.g., on the termination signal of the pol-III promoter used.

In an embodiment, the tail domain comprises variable 3' sequence derived from the DNA template if a T7 promoter is used.

In an embodiment, the tail domain comprises variable 3' sequence derived from the DNA template, e.g., if in vitro transcription is used to generate the RNA molecule.

In an embodiment, the tail domain comprises variable 3' sequence derived from the DNA template, e.g., if a pol-II promoter is used to drive transcription.

In an embodiment a gRNA has the following structure:
5' [targeting domain]-[first complementarity domain]-[linking domain]-[second complementarity domain]-[proximal domain]-3'
wherein, the targeting domain comprises a core domain and optionally a secondary domain, and is 10 to 50 nucleotides in length; the first complementarity domain is 5 to 25 nucleotides in length and, In an embodiment has at least 50, 60, 70, 80, 85, 90, 95, 98 or 99% homology with a reference first complementarity domain disclosed herein; the linking domain is 1 to 5 nucleotides in length; the proximal domain is 5 to 20 nucleotides in length and, in an embodiment has at least 50, 60, 70, 80, 85, 90, 95, 98 or 99% homology with a reference proximal domain disclosed herein; and the tail domain is absent or a nucleotide sequence is 1 to 50 nucleotides in length and, in an embodiment has at least 50, 60, 70, 80, 85, 90, 95, 98 or 99% homology with a reference tail domain disclosed herein.

(9) Exemplary Chimeric gRNAs

In an embodiment, a unimolecular, or chimeric, gRNA comprises, preferably from 5' to 3': a targeting domain, e.g., comprising 15, 16, 17, 18, 19, 20, 21, 22, 23, 24, 25, or 26 nucleotides (which is complementary to a target nucleic acid); a first complementarity domain; a linking domain; a second complementarity domain (which is complementary to the first complementarity domain); a proximal domain; and a tail domain, wherein, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein. In an embodiment, the proximal and tail domain, when taken together, comprise at least 15, 18, 20, 25, 30, 31, 35, 40, 45, 49, 50, or 53 nucleotides. In an embodiment, there are at least 15, 18, 20, 25, 30, 31, 35, 40, 45, 49, 50, or 53 nucleotides 3' to the last nucleotide of the second complementarity domain. In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain. In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number:

NNNNNNNNNNNNNNNNNNNNGUUUUAGAGCUAGAAAUAGCAAGUUAAAAU (SEQ ID NO: 1329)

AAGGCUAGUCCGUUAUCAACUUGAAAAAGUGGCACCGAGUCGGUGCUUUU

UU.

In an embodiment, the unimolecular, or chimeric, gRNA molecule is a S. pyogenes gRNA molecule.

In some embodiments, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number:

(SEQ ID NO: 1330)
NNNNNNNNNNNNNNNNNNNNGUUUAGUACUCUGGAAACAGAAUCUACUA

AAACAAGGCAAAAUGCCGUGUUUAUCUCGUCAACUUGUUGGCGAGAUUUU

UU.

In an embodiment, the unimolecular, or chimeric, gRNA molecule is a *S. aureus* gRNA molecule.

In some embodiments, the targeting domain in the exemplary chimeric gRNA is or comprises a sequence selected from any of SEQ ID NOS: 1048, 1053, 1229-1315. In some embodiments, the targeting domain in the exemplary chimeric gRNA is or comprises a sequence selected from any of those set forth in Table 16 or 17.

The sequences and structures of exemplary chimeric gRNAs are also shown in FIGS. 14A-14B.

(10) Exemplary Modular gRNAs

In an embodiment, a modular gRNA comprises first and second strands. The first strand comprises, preferably from 5' to 3'; a targeting domain, e.g., comprising 15, 16, 17, 18, 19, 20, 21, 22, 23, 24, 25, or 26 nucleotides; a first complementarity domain. The second strand comprises, preferably from 5' to 3': optionally a 5' extension domain; a second complementarity domain; a proximal domain; and a tail domain, wherein: (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein. In an embodiment, the proximal and tail domain, when taken together, comprise at least 15, 18, 20, 25, 30, 31, 35, 40, 45, 49, 50, or 53 nucleotides. In an embodiment there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In some embodiments, the targeting domain in the exemplary modular gRNA is or comprises a sequence selected from any of SEQ ID NOS: 1048, 1053, 1229-1315. In some embodiments, the targeting domain in the exemplary chimeric gRNA is or comprises a sequence selected from any of those set forth in Table 16 or 17.

b) Cas9

Cas9 molecules of a variety of species can be used in the methods and compositions described herein. While the *S. pyogenes*, *S. aureus*, *N. meningitidis*, and *S. thermophilus* Cas9 molecules are the subject of much of the disclosure herein, Cas9 molecules of, derived from, or based on the Cas9 proteins of other species listed herein can be used as well. In other words, while the much of the description herein uses *S. pyogenes*, *S. aureus*, *N meningitidis*, and *S. thermophilus* Cas9 molecules, Cas9 molecules from the other species can replace them. Such species include: *Acidovorax avenae*, *Actinobacillus pleuropneumoniae*, *Actinobacillus succinogenes*, *Actinobacillus suis*, *Actinomyces* sp., *Cycliphilusdenitrificans*, *Aminomonas paucivorans*, *Bacillus cereus*, *Bacillus smithii*, *Bacillus thuringiensis*, *Bacteroides* sp., *Blastopirellula marina*, *Bradyrhizobium* sp., *Brevibacillus laterosporus*, *Campylobacter coli*, *Campylobacter jejuni*, *Campylobacter lari*, *Candidatus puniceispirillum*, *Clostridium cellulolyticum*, *Clostridium perfringens*, *Corynebacterium accolens*, *Corynebacterium diphtheria*, *Corynebacterium matruchotii*, *Dinoroseobacter shibae*, *Eubacterium dolichum*, *Gammaproteobacterium*, *Gluconacetobacter diazotrophicus*, *Haemophilus parainfluenzae*, *Haemophilus sputorum*, *Helicobacter canadensis*, *Helicobacter cinaedi*, *Helicobacter mustelae*, *Ilyobacter polytropus*, *Kingella kingae*, *Lactobacillus crispatus*, *Listeria ivanovii*, *Listeria monocytogenes*, *Listeriaceae bacterium*, *Methylocystis* sp., *Methylosinus trichosporium*, *Mobiluncus mulieris*, *Neisseria bacilliformis*, *Neisseria cinerea*, *Neisseria flavescens*, *Neisseria lactamica*, *Neisseria meningitidis*, *Neisseria* sp., *Neisseria wadsworthii*, *Nitrosomonas* sp., *Parvibaculum lavamentivorans*, *Pasteurella multocida*, *Phascolarctobacterium succinatutens*, *Ralstonia syzygii*, *Rhodopseudomonas palustris*, *Rhodovulum* sp., *Simonsiella muelleri*, *Sphingomonas* sp., *Sporolactobacillus vineae*, *Staphylococcus aureus*, *Staphylococcus lugdunensis*, *Streptococcus* sp., *Subdoligranulum* sp., *Tistrella mobilis*, *Treponema* sp., or *Verminephrobacter eiseniae*.

A Cas9 molecule, or Cas9 polypeptide, as that term is used herein, refers to a molecule or polypeptide that can interact with a gRNA molecule and, in concert with the gRNA molecule, homes or localizes to a site which comprises a target domain and PAM sequence. Cas9 molecule and Cas9 polypeptide, as those terms are used herein, refer to naturally occurring Cas9 molecules and to engineered, altered, or modified Cas9 molecules or Cas9 polypeptides that differ, e.g., by at least one amino acid residue, from a reference sequence, e.g., the most similar naturally occurring Cas9 molecule or the sequence of amino acids set forth in SEQ ID NOS: 1331-1336, 1338, 1340 and 1341

(1) Cas9 Domains

Crystal structures have been determined for two different naturally occurring bacterial Cas9 molecules (Jinek et al., Science, 343(6176):1247997, 2014) and for *S. pyogenes* Cas9 with a guide RNA (e.g., a synthetic fusion of crRNA and tracrRNA) (Nishimasu et al., Cell, 156:935-949, 2014; and Anders et al., Nature, 2014, doi: 10.1038/nature13579).

A naturally occurring Cas9 molecule comprises two lobes: a recognition (REC) lobe and a nuclease (NUC) lobe; each of which further comprises domains described herein. The domain nomenclature and the numbering of the amino acid residues encompassed by each domain used throughout this disclosure is as described in Nishimasu et al. The numbering of the amino acid residues is with reference to Cas9 from *S. pyogenes*.

The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long α-helix and arginine rich region and comprises amino acids 60-93 of the sequence of *S. pyogenes* Cas9. The REC1 domain is important for recognition of the repeat: anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of *S. pyogenes* Cas9. These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of the sequence of *S. pyogenes* Cas9.

The NUC lobe comprises the RuvC domain (also referred to herein as RuvC-like domain), the HNH domain (also referred to herein as HNH-like domain), and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of *S. pyogenes* Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases, and cleaves a single strand, e.g., the complementary strand of the target nucleic acid molecule. The HNH domain lies between the RuvC II-III motifs and comprises amino acids 775-908 of the sequence of *S. pyogenes* Cas9. The PI domain interacts with the PAM of the target nucleic acid molecule, and comprises amino acids 1099-1368 of the sequence of *S. pyogenes* Cas9.

(a) A RuvC-Like Domain and an HNH-Like Domain

In an embodiment, a Cas9 molecule or Cas9 polypeptide comprises an HNH-like domain and a RuvC-like domain. In an embodiment, cleavage activity is dependent on a RuvC-like domain and an HNH-like domain. A Cas9 molecule or Cas9 polypeptide, e.g., an eaCas9 molecule or eaCas9 polypeptide, can comprise one or more of the following domains: a RuvC-like domain and an HNH-like domain. In an embodiment, a Cas9 molecule or Cas9 polypeptide is an eaCas9 molecule or eaCas9 polypeptide and the eaCas9 molecule or eaCas9 polypeptide comprises a RuvC-like domain, e.g., a RuvC-like domain described below, and/or an HNH-like domain, e.g., an HNH-like domain described below.

(b) RuvC-Like Domains

In an embodiment, a RuvC-like domain cleaves, a single strand, e.g., the non-complementary strand of the target nucleic acid molecule. The Cas9 molecule or Cas9 polypeptide can include more than one RuvC-like domain (e.g., one, two, three or more RuvC-like domains). In an embodiment, a RuvC-like domain is at least 5, 6, 7, 8 amino acids in length but not more than 20, 19, 18, 17, 16 or 15 amino acids in length. In an embodiment, the Cas9 molecule or Cas9 polypeptide comprises an N-terminal RuvC-like domain of about 10 to 20 amino acids, e.g., about 15 amino acids in length.

(c) N-Terminal RuvC-Like Domains

Some naturally occurring Cas9 molecules comprise more than one RuvC-like domain with cleavage being dependent on the N-terminal RuvC-like domain. Accordingly, Cas9 molecules or Cas9 polypeptide can comprise an N-terminal RuvC-like domain.

(d) Additional RuvC-Like Domains

In addition to the N-terminal RuvC-like domain, the Cas9 molecule or Cas9 polypeptide, e.g., an eaCas9 molecule or eaCas9 polypeptide, can comprise one or more additional RuvC-like domains. In an embodiment, the Cas9 molecule or Cas9 polypeptide can comprise two additional RuvC-like domains Preferably, the additional RuvC-like domain is at least 5 amino acids in length and, e.g., less than 15 amino acids in length, e.g., 5 to 10 amino acids in length, e.g., 8 amino acids in length.

(e) HNH-Like Domains

In an embodiment, an HNH-like domain cleaves a single stranded complementary domain, e.g., a complementary strand of a double stranded nucleic acid molecule. In an embodiment, an HNH-like domain is at least 15, 20, 25 amino acids in length but not more than 40, 35 or 30 amino acids in length, e.g., 20 to 35 amino acids in length, e.g., 25 to 30 amino acids in length. Exemplary HNH-like domains are described below.

In an embodiment, the HNH-like domain is cleavage competent.

In an embodiment, the HNH-like domain is cleavage incompetent.

(2) Cas9 Activities (a) Nuclease and Helicase Activities

In an embodiment, the Cas9 molecule or Cas9 polypeptide is capable of cleaving a target nucleic acid molecule. Typically wild type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 molecule or eaCas9 polypeptide In an embodiment, an eaCas9 molecule or eaCas9 polypeptide comprises one or more of the following activities:
  a nickase activity, i.e., the ability to cleave a single strand, e.g., the non-complementary strand or the complementary strand, of a nucleic acid molecule;
  a double stranded nuclease activity, i.e., the ability to cleave both strands of a double stranded nucleic acid and create a double stranded break, which in an embodiment is the presence of two nickase activities;
  an endonuclease activity;
  an exonuclease activity; and
  a helicase activity, i.e., the ability to unwind the helical structure of a double stranded nucleic acid.

In an embodiment, an enzymatically active or eaCas9 molecule or eaCas9 polypeptide cleaves both strands and results in a double stranded break. In an embodiment, an eaCas9 molecule cleaves only one strand, e.g., the strand to which the gRNA hybridizes to, or the strand complementary to the strand the gRNA hybridizes with. In an embodiment, an eaCas9 molecule or eaCas9 polypeptide comprises cleavage activity associated with an HNH-like domain. In an embodiment, an eaCas9 molecule or eaCas9 polypeptide comprises cleavage activity associated with an N-terminal RuvC-like domain. In an embodiment, an eaCas9 molecule or eaCas9 polypeptide comprises cleavage activity associated with an HNH-like domain and cleavage activity associated with an N-terminal RuvC-like domain. In an embodiment, an eaCas9 molecule or eaCas9 polypeptide comprises an active, or cleavage competent, HNH-like domain and an inactive, or cleavage incompetent, N-terminal RuvC-like domain. In an embodiment, an eaCas9 molecule or eaCas9 polypeptide comprises an inactive, or cleavage incompetent, HNH-like domain and an active, or cleavage competent, N-terminal RuvC-like domain.

Some Cas9 molecules or Cas9 polypeptides have the ability to interact with a gRNA molecule, and in conjunction with the gRNA molecule localize to a core target domain, but are incapable of cleaving the target nucleic acid, or incapable of cleaving at efficient rates. Cas9 molecules having no, or no substantial, cleavage activity are referred to herein as an eiCas9 molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

(b) Targeting and PAMs

A Cas9 molecule or Cas9 polypeptide, is a polypeptide that can interact with a guide RNA (gRNA) molecule and, in concert with the gRNA molecule, localizes to a site which comprises a target domain and a PAM sequence.

In an embodiment, the ability of an eaCas9 molecule or eaCas9 polypeptide to interact with and cleave a target nucleic acid is PAM sequence dependent. A PAM sequence is a sequence in the target nucleic acid. In an embodiment, cleavage of the target nucleic acid occurs upstream from the PAM sequence. EaCas9 molecules from different bacterial species can recognize different sequence motifs (e.g., PAM sequences). In an embodiment, an eaCas9 molecule of S. pyogenes recognizes the sequence motif NGG, NAG, NGA and directs cleavage of a target nucleic acid sequence 1 to 10, e.g., 3 to 5, base pairs upstream from that sequence. See, e.g., Mali et al., SCIENCE 2013; 339(6121): 823-826. In an embodiment, an eaCas9 molecule of S. thermophilus recognizes the sequence motif NGGNG and/or NNAGAAW (W=A or T) and directs cleavage of a target nucleic acid sequence 1 to 10, e.g., 3 to 5, base pairs upstream from these sequences. See, e.g., Horvath et al., SCIENCE 2010; 327 (5962):167-170, and Deveau et al., J Bacteriol 2008; 190(4): 1390-1400. In an embodiment, an eaCas9 molecule of S. mutans recognizes the sequence motif NGG and/or NAAR (R=A or G)) and directs cleavage of a core target nucleic acid sequence 1 to 10, e.g., 3 to 5 base pairs, upstream from this sequence. See, e.g., Deveau et al., J Bacteriol 2008; 190(4): 1390-1400. In an embodiment, an eaCas9 molecule of S. aureus recognizes the sequence motif NNGRR (R=A or G) and directs cleavage of a target nucleic acid sequence 1 to 10, e.g., 3 to 5, base pairs upstream from that sequence. In an embodiment, an eaCas9 molecule of S. aureus recognizes the sequence motif NNGRRT (R=A or G) and directs cleavage of a target nucleic acid sequence 1 to 10, e.g., 3 to 5, base pairs upstream from that sequence. In an embodiment, an eaCas9 molecule of S. aureus recognizes the sequence motif NNGRRV (R=A or G) and directs cleavage of a target nucleic acid sequence 1 to 10, e.g., 3 to 5, base pairs upstream from that sequence. In an embodiment, an eaCas9 molecule of N. meningitidis recognizes the sequence motif NNNNGATT or NNNGCTT (R=A or G, V=A, G or C and directs cleavage of a target nucleic acid sequence 1 to 10, e.g., 3 to 5, base pairs upstream from that sequence. See, e.g., Hou et al., PNAS EARLY EDITION 2013, 1-6. The ability of a Cas9 molecule to recognize a PAM sequence can be determined, e.g., using a transformation assay described in Jinek et al., SCIENCE 2012 337:816. In the aforementioned embodiments, N can be any nucleotide residue, e.g., any of A, G, C or T.

As is discussed herein, Cas9 molecules can be engineered to alter the PAM specificity of the Cas9 molecule.

Exemplary naturally occurring Cas9 molecules are described in Chylinski et al., RNA Biology 2013 10:5, 727-737. Such Cas9 molecules include Cas9 molecules of a cluster 1-78 bacterial family.

Exemplary naturally occurring Cas9 molecules include a Cas9 molecule of a cluster 1 bacterial family. Examples include a Cas9 molecule of: S. pyogenes (e.g., strain SF370, MGAS10270, MGAS10750, MGAS2096, MGAS315, MGAS5005, MGAS6180, MGAS9429, NZ131 and SSI-1), S. thermophilus (e.g., strain LMD-9), S. pseudoporcinus (e.g., strain SPIN 20026), S. mutans (e.g., strain UA159, NN2025), S. macacae (e.g., strain NCTC11558), S. gallolyticus (e.g., strain UCN34, ATCC BAA-2069), S. equines (e.g., strain ATCC 9812, MGCS 124), S. dysdalactiae (e.g., strain GGS 124), S. bovis (e.g., strain ATCC 700338), S. anginosus (e.g., strain F0211), S. agalactiae (e.g., strain NEM316, A909), Listeria monocytogenes (e.g., strain F6854), Listeria innocua (L. innocua, e.g., strain Clip11262), Enterococcus italicus (e.g., strain DSM 15952), or Enterococcus faecium (e.g., strain 1,231,408). Another exemplary Cas9 molecule is a Cas9 molecule of Neisseria meningitidis (Hou et al., PNAS Early Edition 2013, 1-6).

In an embodiment, a Cas9 molecule or Cas9 polypeptide, e.g., an eaCas9 molecule or eaCas9 polypeptide, comprises an amino acid sequence:

having 60%, 65%, 70%, 75%, 80%, 85%, 90%, 95%, 96%, 97%, 98% or 99% homology with; differs at no more than, 2, 5, 10, 15, 20, 30, or 40% of the amino acid residues when compared with;

differs by at least 1, 2, 5, 10 or 20 amino acids but by no more than 100, 80, 70, 60, 50, 40 or 30 amino acids from; or is identical to any Cas9 molecule sequence described herein, or a naturally occurring Cas9 molecule sequence, e.g., a Cas9 molecule from a species listed herein or described in Chylinski et al., RNA Biology 2013 10:5, 727-737; Hou et al., PNAS Early Edition 2013, 1-6; SEQ ID NOS:1331-1334 (S. mutans (SEQ ID NO:1331); S. pyogenes (SEQ ID NO:1332); S. thermophilus (SEQ ID NO:1333); L. innocua (SEQ ID NO:1334)). In an embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to home to a target nucleic acid.

In an embodiment, a Cas9 molecule or Cas9 polypeptide comprises the amino acid sequence of the consensus sequence of FIGS. 15A-15G, wherein "*" indicates any amino acid found in the corresponding position in the amino acid sequence of a Cas9 molecule of S. mutans (SEQ ID NO:1331); S. pyogenes (SEQ ID NO:1332); S. thermophilus (SEQ ID NO:1333); L. innocua (SEQ ID NO:1334), and "-" indicates any amino acid. In an embodiment, a Cas9 molecule or Cas9 polypeptide differs from the sequence of the consensus sequence disclosed in FIGS. 15A-15G by at least 1, but no more than 2, 3, 4, 5, 6, 7, 8, 9, or 10 amino acid residues. In an embodiment, a Cas9 molecule or Cas9 polypeptide comprises the amino acid sequence of SEQ ID NO:1336 of FIGS. 16A-16C, wherein "*" indicates any amino acid found in the corresponding position in the amino acid sequence of a Cas9 molecule of *S. pyogenes* (SEQ ID NO:1336), or *N. meningitides* (SEQ ID NO:1335), "-" indicates any amino acid, and "-" indicates any amino acid or absent. In an embodiment, a Cas9 molecule or Cas9 polypeptide differs from the sequence of SEQ ID NO:1335 or 1336 disclosed in FIGS. 16A-16C by at least 1, but no more than 2, 3, 4, 5, 6, 7, 8, 9, or 10 amino acid residues.

A comparison of the sequence of a number of Cas9 molecules indicate that certain regions are conserved. These are identified below as:

region 1 (residues 1 to 180, or in the case of region 1' residues 120 to 180)
region 2 (residues 360 to 480);
region 3 (residues 660 to 720);
region 4 (residues 817 to 900); and
region 5 (residues 900 to 960);

In an embodiment, a Cas9 molecule or Cas9 polypeptide comprises regions 1-5, together with sufficient additional Cas9 molecule sequence to provide a biologically active molecule, e.g., a Cas9 molecule having at least one activity described herein. In an embodiment, each of regions 1-6, independently, have, 50%, 60%, 70%, or 80% homology with the corresponding residues of a Cas9 molecule or Cas9 polypeptide described herein, e.g., a sequence from FIGS. 15A-15G or from FIGS. 16A-16C.

In an embodiment, a Cas9 molecule or Cas9 polypeptide, e.g., an eaCas9 molecule or eaCas9 polypeptide, comprises an amino acid sequence referred to as region 1: having 50%, 60%, 70%, 80%, 85%, 90%, 95%, 96%, 97%, 98% or 99% homology with amino acids 1-180 (the numbering is according to the motif sequence in FIGS. 15A-15G; 52% of residues in the four Cas9 sequences in FIGS. 15A-15G are conserved) of the amino acid sequence of Cas9 of *S. pyogenes*; differs by at least 1, 2, 5, 10 or 20 amino acids but by no more than 90, 80, 70, 60, 50, 40 or 30 amino acids from amino acids 1-180 of the amino acid sequence of Cas9 of *S. pyogenes, S. thermophilus, S. mutans* or *L. innocua*; or is identical to 1-180 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 1': having 55%, 60%, 65%, 70%, 75%, 80%, 85%, 90%, 95%, 96%, 97%, 98% or 99% homology with amino acids 120-180 (55% of residues in the four Cas9 sequences in FIGS. 15A-15G are conserved) of the amino acid sequence of Cas9 of *S. pyogenes, S. thermophilus, S. mutans* or *L. innocua*; differs by at least 1, 2, or 5 amino acids but by no more than 35, 30, 25, 20 or 10 amino acids from amino acids 120-180 of the amino acid sequence of Cas9 of *S. pyogenes, S. thermophilus, S. mutans* or *L. innocua*; or is identical to 120-180 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 2: having 50%, 55%, 60%, 65%, 70%, 75%, 80%, 85%, 90%, 95%, 96%, 97%, 98% or 99% homology with amino acids 360-480 (52% of residues in the four Cas9 sequences in FIGS. 11A-11G are conserved) of the amino acid sequence of Cas9 of *S. pyogenes, S. thermophilus, S. mutans* or *L. innocua*; differs by at least 1, 2, or 5 amino acids but by no more than 35, 30, 25, 20 or 10 amino acids from amino acids 360-480 of the amino acid sequence of Cas9 of *S. pyogenes, S. thermophilus, S. mutans* or *L. innocua*; or is identical to 360-480 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 3: having 55%, 60%, 65%, 70%, 75%, 80%, 85%, 90%, 95%, 96%, 97%, 98%, or 99% homology with amino acids 660-720 (56% of residues in the four Cas9 sequences in FIGS. 15A-15G are conserved) of the amino acid sequence of Cas9 of *S. pyogenes, S. thermophilus, S. mutans* or *L. innocua*; differs by at least 1, 2, or 5 amino acids but by no more than 35, 30, 25, 20 or 10 amino acids from amino acids 660-720 of the amino acid sequence of Cas9 of *S. pyogenes, S. thermophilus, S. mutans* or *L. innocua*; or is identical to 660-720 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 4: having 50%, 55%, 60%, 65%, 70%, 75%, 80%, 85%, 90%, 95%, 96%, 97%, 98%, or 99% homology with amino acids 817-900 (55% of residues in the four Cas9 sequences in FIGS. 11A-11G are conserved) of the amino acid sequence of Cas9 of *S. pyogenes, S. thermophilus, S. mutans* or *L. innocua*; differs by at least 1, 2, or 5 amino acids but by no more than 35, 30, 25, 20 or 10 amino acids from amino acids 817-900 of the amino acid sequence of Cas9 of *S. pyogenes, S. thermophilus, S. mutans* or *L. innocua*; or is identical to 817-900 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 5: having 50%, 55%, 60%, 65%, 70%, 75%, 80%, 85%, 90%, 95%, 96%, 97%, 98%, or 99% homology with amino acids 900-960 (60% of residues in the four Cas9 sequences in FIGS. 15A-15G are conserved) of the amino acid sequence of Cas9 of *S. pyogenes, S. thermophilus, S. mutans* or *L. innocua*; differs by at least 1, 2, or 5 amino acids but by no more than 35, 30, 25, 20 or 10 amino acids from amino acids 900-960 of the amino acid sequence of Cas9 of *S. pyogenes, S. thermophilus, S. mutans* or *L. innocua*; or is identical to 900-960 of the amino acid sequence of Cas9 of *S. pyogenes, S. thermophilus, S. mutans* or *L. innocua*.

(3) Engineered or Altered Cas9 Molecules and Cas9 Polypeptides

Cas9 molecules and Cas9 polypeptides described herein, e.g., naturally occurring Cas9 molecules, can possess any of a number of properties, including: nickase activity, nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In an embodiment, a Cas9 molecule or Cas9 polypeptide can include all or a subset of these properties. In typical embodiments, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides ("engineered," as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity, (as compared with a naturally occurring or other reference Cas9 molecule) or altered helicase activity. As discussed herein, an engineered Cas9 molecule or Cas9 polypeptide can have nickase activity (as opposed to double strand nuclease activity). In an embodiment an engineered Cas9 molecule or Cas9 polypeptide can have an alteration that alters its size, e.g., a deletion of amino acid sequence that reduces its size, e.g., without significant effect on one or more, or any Cas9 activity. In an embodiment, an engineered Cas9 molecule or Cas9 polypeptide can comprise an alteration that affects PAM recognition. E.g., an engineered Cas9 molecule can be altered to recognize a PAM sequence other than that recognized by the endogenous wild-type PI domain. In an embodiment a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring, Cas9 molecules or Cas9 polypeptides, to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids); insertions; or deletions. In an embodiment, a Cas9 molecule or Cas9 polypeptide can comprises one or more mutations or differences, e.g., at least 1, 2, 3, 4, 5, 10, 15, 20, 30, 40 or 50 mutations but less than 200, 100, or 80 mutations relative to a reference, e.g., a parental, Cas9 molecule.

In an embodiment, a mutation or mutations do not have a substantial effect on a Cas9 activity, e.g. a Cas9 activity described herein. In an embodiment, a mutation or mutations have a substantial effect on a Cas9 activity, e.g. a Cas9 activity described herein.

(a) Non-Cleaving and Modified-Cleavage Cas9 Molecules and Cas9 Polypeptides

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

(b) Modified Cleavage eaCas9 Molecules and eaCas9 Polypeptides

In an embodiment, an eaCas9 molecule or eaCas9 polypeptide comprises one or more of the following activities: cleavage activity associated with an N-terminal RuvC-like domain; cleavage activity associated with an HNH-like domain; cleavage activity associated with an HNH-like domain and cleavage activity associated with an N-terminal RuvC-like domain.

In an embodiment, an eaCas9 molecule or eaCas9 polypeptide comprises an active, or cleavage competent, HNH-like domain and an inactive, or cleavage incompetent, N-terminal RuvC-like domain. An exemplary inactive, or cleavage incompetent N-terminal RuvC-like domain can have a mutation of an aspartic acid in an N-terminal RuvC-like domain, e.g., an aspartic acid at position 9 of the consensus sequence disclosed in FIGS. 15A-15G or an aspartic acid at position 10 of SEQ ID NO:1336, e.g., can be substituted with an alanine. In an embodiment, the eaCas9 molecule or eaCas9 polypeptide differs from wild type in the N-terminal RuvC-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes*, or *S. thermophilus*. In an embodiment, the reference Cas9 molecule is the naturally occurring Cas9 molecule having the closest sequence identity or homology.

In an embodiment, an eaCas9 molecule or eaCas9 polypeptide comprises an inactive, or cleavage incompetent, HNH domain and an active, or cleavage competent, N-terminal RuvC-like domain. Exemplary inactive, or cleavage incompetent HNH-like domains can have a mutation at one or more of: a histidine in an HNH-like domain, e.g., a histidine shown at position 856 of FIGS. 15A-15G, e.g., can be substituted with an alanine; and one or more asparagines in an HNH-like domain, e.g., an asparagine shown at position 870 of FIGS. 15A-15G and/or at position 879 of FIGS. 15A-15G, e.g., can be substituted with an alanine. In an embodiment, the eaCas9 differs from wild type in the HNH-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes*, or *S. thermophilus*. In an embodiment, the reference Cas9 molecule is the naturally occurring Cas9 molecule having the closest sequence identity or homology.

In an embodiment, an eaCas9 molecule or eaCas9 polypeptide comprises an inactive, or cleavage incompetent, HNH domain and an active, or cleavage competent, N-terminal RuvC-like domain. Exemplary inactive, or cleavage incompetent HNH-like domains can have a mutation at one or more of: a histidine in an HNH-like domain, e.g., a histidine shown at position 856 of FIGS. 15A-15G, e.g., can be substituted with an alanine; and one or more asparagines in an HNH-like domain, e.g., an asparagine shown at position 870 of FIGS. 15A-15G and/or at position 879 of FIGS. 15A-15G, e.g., can be substituted with an alanine. In an embodiment, the eaCas9 differs from wild type in the HNH-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S.*

*pyogenes*, or *S. thermophilus*. In an embodiment, the reference Cas9 molecule is the naturally occurring Cas9 molecule having the closest sequence identity or homology.

(c) Alterations in the Ability to Cleave One or Both Strands of a Target Nucleic Acid In an embodiment, exemplary Cas9 activities comprise one or more of PAM specificity, cleavage activity, and helicase activity. A mutation(s) can be present, e.g., in: one or more RuvC-like domain, e.g., an N-terminal RuvC-like domain; an HNH-like domain; a region outside the RuvC-like domains and the HNH-like domain. In some embodiments, a mutation(s) is present in a RuvC-like domain, e.g., an N-terminal RuvC-like. In some embodiments, a mutation(s) is present in an HNH-like domain. In some embodiments, mutations are present in both a RuvC-like domain, e.g., an N-terminal RuvC-like domain, and an HNH-like domain.

Exemplary mutations that may be made in the RuvC domain or HNH domain with reference to the *S. pyogenes* sequence include: D10A, E762A, H840A, N854A, N863A and/or D986A.

In an embodiment, a Cas9 molecule or Cas9 polypeptide is an eiCas9 molecule or eiCas9 polypeptide comprising one or more differences in a RuvC domain and/or in an HNH domain as compared to a reference Cas9 molecule, and the eiCas9 molecule or eiCas9 polypeptide does not cleave a nucleic acid, or cleaves with significantly less efficiency than does wildype, e.g., when compared with wild type in a cleavage assay, e.g., as described herein, cuts with less than 50, 25, 10, or 1% of a reference Cas9 molecule, as measured by an assay described herein.

Whether or not a particular sequence, e.g., a substitution, may affect one or more activity, such as targeting activity, cleavage activity, etc., can be evaluated or predicted, e.g., by evaluating whether the mutation is conservative or by the method described in Section IV. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. aureus, S. pyogenes*, or *C. jejuni* as follows: its ability to modulate, e.g., decreased or increased, cleavage of a double stranded break (endonuclease and/or exonuclease activity), e.g., as compared to a naturally occurring Cas9 molecule (e.g., a Cas9 molecule of *S. aureus, S. pyogenes*, or *C. jejuni*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. aureus, S. pyogenes*, or *C. jejuni*); or the ability to cleave a nucleic acid molecule, e.g., a double stranded or single stranded nucleic acid molecule, can be eliminated.

In an embodiment, the altered Cas9 molecule or Cas9 polypeptide is an eaCas9 molecule or eaCas9 polypeptide comprising one or more of the following activities: cleavage activity associated with a RuvC domain; cleavage activity associated with an HNH domain; cleavage activity associated with an HNH domain and cleavage activity associated with a RuvC domain.

In an embodiment, the altered Cas9 molecule or Cas9 polypeptide is an eiCas9 molecule or eaCas9 polypeptide which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can be a naturally occurring unmodified Cas9 molecule, e.g., a naturally occurring Cas9 molecule such as a Cas9 molecule of *S. pyogenes, S. thermophilus, S. aureus, C. jejuni* or *N. meningitidis*. In an embodiment, the reference Cas9 molecule is the naturally occurring Cas9 molecule having the closest sequence identity or homology. In an embodiment, the eiCas9 molecule or eiCas9 polypeptide lacks substantial cleavage activity associated with a RuvC domain and cleavage activity associated with an HNH domain.

In an embodiment, the altered Cas9 molecule or Cas9 polypeptide is an eaCas9 molecule or eaCas9 polypeptide comprising the fixed amino acid residues of *S. pyogenes* shown in the consensus sequence disclosed in FIGS. 15A-15G, and has one or more amino acids that differ from the amino acid sequence of *S. pyogenes* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 15A-15G or SEQ ID NO:1336.

In an embodiment, the altered Cas9 molecule or Cas9 polypeptide comprises a sequence in which:

the sequence corresponding to the fixed sequence of the consensus sequence disclosed in FIGS. 15A-15G differs at no more than 1, 2, 3, 4, 5, 10, 15, or 20% of the fixed residues in the consensus sequence disclosed in FIGS. 15A-15G;

the sequence corresponding to the residues identified by "*" in the consensus sequence disclosed in FIGS. 15A-15G differ at no more than 1, 2, 3, 4, 5, 10, 15, 20, 25, 30, 35, or 40% of the "*" residues from the corresponding sequence of naturally occurring Cas9 molecule, e.g., an *S. pyogenes* Cas9 molecule; and, the sequence corresponding to the residues identified by "-" in the consensus sequence disclosed in FIGS. 15A-15G differ at no more than 5, 10, 15, 20, 25, 30, 35, 40, 45, 55, or 60% of the "-" residues from the corresponding sequence of naturally occurring Cas9 molecule, e.g., an *S. pyogenes* Cas9 molecule.

In an embodiment, the altered Cas9 molecule or Cas9 polypeptide is an eaCas9 molecule or eaCas9 polypeptide comprising the fixed amino acid residues of *S. thermophilus* shown in the consensus sequence disclosed in FIGS. 15A-15G, and has one or more amino acids that differ from the amino acid sequence of *S. thermophilus* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 15A-15G.

In an embodiment the altered Cas9 molecule or Cas9 polypeptide comprises a sequence in which:

the sequence corresponding to the fixed sequence of the consensus sequence disclosed in FIGS. 15A-15G differs at no more than 1, 2, 3, 4, 5, 10, 15, or 20% of the fixed residues in the consensus sequence disclosed in FIGS. 15A-15G;

the sequence corresponding to the residues identified by "*" in the consensus sequence disclosed in FIGS. 15A-15G differ at no more than 1, 2, 3, 4, 5, 10, 15, 20, 25, 30, 35, or 40% of the "*" residues from the corresponding sequence of naturally occurring Cas9 molecule, e.g., an *S. thermophilus* Cas9 molecule; and, the sequence corresponding to the residues identified by "-" in the consensus sequence disclosed in FIGS. 15A-15G differ at no more than 5, 10, 15, 20, 25, 30, 35, 40, 45, 55, or 60% of the "-" residues from the corresponding sequence of naturally occurring Cas9 molecule, e.g., an *S. thermophilus* Cas9 molecule.

In an embodiment, the altered Cas9 molecule or Cas9 polypeptide is an eaCas9 molecule or eaCas9 polypeptide comprising the fixed amino acid residues of *S. mutans* shown in the consensus sequence disclosed in FIGS. 15A-15G, and has one or more amino acids that differ from the amino acid sequence of *S. mutans* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 15A-15G.

In an embodiment, the altered Cas9 molecule or Cas9 polypeptide comprises a sequence in which:

the sequence corresponding to the fixed sequence of the consensus sequence disclosed in FIGS. 15A-15G differs at no more than 1, 2, 3, 4, 5, 10, 15, or 20% of the fixed residues in the consensus sequence disclosed in FIGS. 15A-15G;

the sequence corresponding to the residues identified by "*" in the consensus sequence disclosed in FIGS. 15A-15G differ at no more than 1, 2, 3, 4, 5, 10, 15, 20, 25, 30, 35, or 40% of the "*" residues from the corresponding sequence of naturally occurring Cas9 molecule, e.g., an *S. mutans* Cas9 molecule; and, the sequence corresponding to the residues identified by "-" in the consensus sequence disclosed in FIGS. 15A-15G differ at no more than 5, 10, 15, 20, 25, 30, 35, 40, 45, 55, or 60% of the "-" residues from the corresponding sequence of naturally occurring Cas9 molecule, e.g., an *S. mutans* Cas9 molecule.

In an embodiment, the altered Cas9 molecule or Cas9 polypeptide is an eaCas9 molecule or eaCas9 polypeptide comprising the fixed amino acid residues of *L. innocula* shown in the consensus sequence disclosed in FIGS. 15A-15G, and has one or more amino acids that differ from the amino acid sequence of *L. innocula* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 15A-15G.

In an embodiment, the altered Cas9 molecule or Cas9 polypeptide comprises a sequence in which:

the sequence corresponding to the fixed sequence of the consensus sequence disclosed in FIGS. 15A-15G differs at no more than 1, 2, 3, 4, 5, 10, 15, or 20% of the fixed residues in the consensus sequence disclosed in FIGS. 15A-15G;

the sequence corresponding to the residues identified by "*" in the consensus sequence disclosed in FIGS. 15A-15G differ at no more than 1, 2, 3, 4, 5, 10, 15, 20, 25, 30, 35, or 40% of the "*" residues from the corresponding sequence of naturally occurring Cas9 molecule, e.g., an *L. innocula* Cas9 molecule; and, the sequence corresponding to the residues identified by "-" in the consensus sequence disclosed in FIGS. 15A-15G differ at no more than 5, 10, 15, 20, 25, 30, 35, 40, 45, 55, or 60% of the "-" residues from the corresponding sequence of naturally occurring Cas9 molecule, e.g., an *L. innocula* Cas9 molecule.

In an embodiment, the altered Cas9 molecule or Cas9 polypeptide, e.g., an eaCas9 molecule, can be a fusion, e.g., of two of more different Cas9 molecules or Cas9 polypeptides, e.g., of two or more naturally occurring Cas9 molecules of different species. For example, a fragment of a naturally occurring Cas9 molecule of one species can be fused to a fragment of a Cas9 molecule of a second species. As an example, a fragment of Cas9 molecule of *S. pyogenes* comprising an N-terminal RuvC-like domain can be fused to a fragment of Cas9 molecule of a species other than *S. pyogenes* (e.g., *S. thermophilus*) comprising an HNH-like domain.

(d) Cas9 Molecules With Altered PAM Recognition or No PAM Recognition

Naturally occurring Cas9 molecules can recognize specific PAM sequences, for example the PAM recognition sequences described above for, e.g., *S. pyogenes, S. thermophilus, S. mutans, S. aureus* and *N. meningitidis*.

In an embodiment, a Cas9 molecule or Cas9 polypeptide has the same PAM specificities as a naturally occurring Cas9 molecule. In other embodiments, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule or Cas9 polypeptide recognizes to decrease off target sites and/or improve specificity; or eliminate a PAM recognition requirement. In an embodiment, a Cas9 molecule can be altered, e.g., to increase length of PAM recognition sequence and/or improve Cas9 specificity to high level of identity, e.g., to decrease off target sites and increase specificity. In an embodiment, the length of the PAM recognition sequence is at least 4, 5, 6, 7, 8, 9, 10 or 15 amino acids in length.

Cas9 molecules or Cas9 polypeptides that recognize different PAM sequences and/or have reduced off-target activity can be generated using directed evolution. Exemplary methods and systems that can be used for directed evolution of Cas9 molecules are described, e.g., in Esvelt et al. Nature 2011, 472(7344): 499-503. Candidate Cas9 molecules can be evaluated.

(4) Nucleic Acids Encoding Cas9 Molecules

Nucleic acids encoding the Cas9 molecules or Cas9 polypeptides, e.g., an eaCas9 molecule or eaCas9 polypeptide, are provided herein.

Exemplary nucleic acids encoding Cas9 molecules or Cas9 polypeptides are described in Cong et al., Science 2013, 399(6121):819-823; Wang et al., Cell 2013, 153(4): 910-918; Mali et al., Science 2013, 399(6121):823-826; Jinek et al., Science 2012, 337(6096):816-821. Another exemplary nucleic acid encoding a Cas9 molecule or Cas9 polypeptide is shown in black in FIG. 8 of WO2015161276.

In an embodiment, a nucleic acid encoding a Cas9 molecule or Cas9 polypeptide can be a synthetic nucleic acid sequence. For example, the synthetic nucleic acid molecule can be chemically modified. In an embodiment, the Cas9 mRNA has one or more (e.g., all of the following properties): it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule or Cas9 polypeptide may comprise a nuclear localization sequence (NLS). Nuclear localization sequences are known in the art.

SEQ ID NO:1337 is an exemplary codon optimized nucleic acid sequence encoding a Cas9 molecule of *S. pyogenes*. SEQ ID NO:1338 is the corresponding amino acid sequence of a *S. pyogenes* Cas9 molecule. SEQ ID NO:1339 is an exemplary codon optimized nucleic acid sequence encoding a Cas9 molecule of *N. meningitidis*. SEQ ID NO:1340 is the corresponding amino acid sequence of a *N. meningitidis* Cas9 molecule. SEQ ID NO:1341 is an exemplary codon optimized nucleic acid sequence encoding a Cas9 molecule of *S. aureus* Cas9. SEQ ID NO:1342 is an amino acid sequence of a *S. aureus* Cas9 molecule.

If any of the above Cas9 sequences are fused with a peptide or polypeptide at the C-terminus, it is understood that the stop codon will be removed.

(5) Other Cas Molecules and Cas Polypeptides

Various types of Cas molecules or Cas polypeptides can be used to practice the inventions disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) are described, e.g., in Haft et al., PLoS Computational Biology 2005, 1(6): e60 and Makarova et al., Nature Review Microbiology 2011, 9:467-477, the contents of both references are incorporated herein by reference in their entirety. Exemplary Cas molecules (and Cas systems) are also shown in Table 18.

TABLE 18

Cas Systems

| Gene name[‡] | System type or subtype | Name from Haft et al.[§] | Structure of encoded protein (PDB accessions)[¶] | Families (and superfamily) of encoded protein[#**] | Representatives |
|---|---|---|---|---|---|
| cas1 | Type I<br>Type II<br>Type III | cas1 | 3GOD, 3LFX and 2YZS | COG1518 | SERP2463, SPy 1047 and ygbT |
| cas2 | Type I<br>Type II<br>Type III | cas2 | 2IVY, 218E and 3EXC | COG1343 and COG3512 | SERP2462, SPy 1048, SPy 1723 (N-terminal domain) and ygbF |
| cas3' | Type I[‡‡] | cas3 | NA | COG1203 | APE1232 and ygcB |
| cas3" | Subtype I-A<br>Subtype I-B | NA | NA | COG2254 | APE1231 and BH0336 |
| cas4 | Subtype I-A<br>Subtype I-B<br>Subtype I-C<br>Subtype I-D<br>Subtype II-B | cas4 and csa1 | NA | COG1468 | APE1239 and BH0340 |
| cas5 | Subtype I-A<br>Subtype I-B<br>Subtype I-C<br>Subtype I-E | cas5a, cas5d, cas5e, cas5h, cas5p, cas5t and cmx5 | 3KG4 | COG1688 (RAMP) | APE1234, BH0337, devS and ygcI |
| cas6 | Subtype I-A<br>Subtype I-B<br>Subtype I-D<br>Subtype III-A<br>Subtype III-B | cas6 and cmx6 | 3I4H | COG1583 and COG5551 (RAMP) | PF1131 and slr7014 |
| casbe | Subtype I-E | cse3 | 1WJ9 | (RAMP) | ygcH |
| cas6f | Subtype I-F | csy4 | 2XLJ | (RAMP) | y1727 |
| cas7 | Subtype I-A<br>Subtype I-B<br>Subtype I-C<br>Subtype I-E | csa2, csd2, cse4, csh2, csp1 and cst2 | NA | COG1857 and COG3649 (RAMP) | devR and ygcJ |
| cas8a1 | Subtype I-A[‡‡] | cmx1, cst1, csx8, csx13 and CXXC-CXXC | NA | BH0338-like | LA3191[§§] and PG2018[§§] |
| cas8a2 | Subtype I-A[‡‡] | csa4 and csx9 | NA | PH0918 | AF0070, AF1873, MJ0385, PF0637, PH0918 and SSO1401 |
| cas8b | Subtype I-B[‡‡] | csh1 and TM1802 | NA | BH0338-like | MTH1090 and TM1802 |
| cas8c | Subtype I-C[‡‡] | csd1 and csp2 | NA | BH0338-like | BH0338 |
| cas9 | Type II[‡‡] | csn1 and csx12 | NA | COG3513 | FTN_0757 and SPy 1046 |

TABLE 18-continued

Cas Systems

| Gene name‡ | System type or subtype | Name from Haft et al.§ | Structure of encoded protein (PDB accessions)¶ | Families (and superfamily) of encoded protein#** | Representatives |
|---|---|---|---|---|---|
| cas10 | Type III‡‡ | cmr2, csm1 and csx11 | NA | COG1353 | MTH326, Rv2823c§§ and TM1794§§ |
| cas10d | Subtype I-D‡‡ | csc3 | NA | COG1353 | slr7011 |
| csy1 | Subtype I-F‡‡ | csy1 | NA | y1724-like | y1724 |
| csy2 | Subtype I-F | csy2 | NA | (RAMP) | y1725 |
| csy3 | Subtype I-F | csy3 | NA | (RAMP) | y1726 |
| cse1 | Subtype I-E‡‡ | cse1 | NA | YgcL-like | ygcL |
| cse2 | Subtype I-E | cse2 | 2ZCA | Ygck-like | ygcK |
| csc1 | Subtype I-D | csc1 | NA | alr1563-like (RAMP) | alr1563 |
| csc2 | Subtype I-D | csc1 and csc2 | NA | COG1337 (RAMP) | slr7012 |
| csa5 | Subtype I-A | csa5 | NA | AF1870 | AF1870, MJ0380, PF0643 and SSO1398 |
| csn2 | Subtype II-A | csn2 | NA | SPy 1049-like | SPy 1049 |
| csm2 | Subtype III-A‡‡ | csm2 | NA | COG1421 | MTH1081 and SERP2460 |
| csm3 | Subtype III-A | csc2 and csm3 | NA | COG1337 (RAMP) | MTH1080 and SERP2459 |
| csm4 | Subtype III-A | csm4 | NA | COG1567 (RAMP) | MTH1079 and SERP2458 |
| csm5 | Subtype III-A | csm5 | NA | COG1332 (RAMP) | MTH1078 and SERP2457 |
| csm6 | Subtype III-A | APE2256 and csm6 | 2WTE | COG1517 | APE2256 and SSO1445 |
| cmr1 | Subtype III-B | cmr1 | NA | COG1367 (RAMP) | PF1130 |
| cmr3 | Subtype III-B | cmr3 | NA | COG1769 (RAMP) | PF1128 |
| cmr4 | Subtype III-B | cmr4 | NA | COG1336 (RAMP) | PF1126 |
| cmr5 | Subtype III-B‡‡ | cmr5 | 2ZOP and 2OEB | COG3337 | MTH324 and PF1125 |
| cmr6 | Subtype III-B | cmr6 | NA | COG1604 (RAMP) | PF1124 |
| csb1 | Subtype I-U | GSU0053 | NA | (RAMP) | Balac_1306 and GSU0053 |
| csb2 | Subtype I-U§§ | NA | NA | (RAMP) | Balac_1305 and GSU0054 |
| csb3 | Subtype I-U | NA | NA | (RAMP) | Balac_1303§§ |
| csx17 | Subtype I-U | NA | NA | NA | Btus_2683 |
| csx14 | Subtype I-U | NA | NA | NA | GSU0052 |
| csx10 | Subtype I-U | csx10 | NA | (RAMP) | Caur_2274 |
| csx16 | Subtype III-U | VVA1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2I71 | COG1517 and COG4006 | MJ1666, NE0113, PF1127 and TM1812 |
| csx15 | Unknown | NA | NA | TTE2665 | TTE2665 |
| csf1 | Type U | csf1 | NA | NA | AFE_1038 |
| csf2 | Type U | csf2 | NA | (RAMP) | AFE_1039 |
| csf3 | Type U | csf3 | NA | (RAMP) | AFE_1040 |
| csf4 | Type U | csf4 | NA | NA | AFE_1037 | c) Cpf1

In some embodiments, the guide RNA or gRNA promotes the specific association targeting of an RNA-guided nuclease such as a Cas9 or a Cpf1 to a target sequence such as a genomic or episomal sequence in a cell. In general, gRNAs can be unimolecular (comprising a single RNA molecule, and referred to alternatively as chimeric), or modular (comprising more than one, and typically two, separate RNA molecules, such as a crRNA and a tracrRNA, which are usually associated with one another, for instance by duplexing). gRNAs and their component parts are described throughout the literature, for instance in Briner et al. (Molecular Cell 56(2), 333-339, Oct. 23, 2014 (Briner), which is incorporated by reference), and in Cotta-Ramusino.

Guide RNAs, whether unimolecular or modular, generally include a targeting domain that is fully or partially complementary to a target, and are typically 10-30 nucleotides in length, and in certain embodiments are 16-24 nucleotides in length (for instance, 16, 17, 18, 19, 20, 21, 22, 23 or 24 nucleotides in length). In some aspects, the targeting domains are at or near the 5' terminus of the gRNA in the case of a Cas9 gRNA, and at or near the 3' terminus in the case of a Cpf1 gRNA. While the foregoing description has focused on gRNAs for use with Cas9, it should be appreciated that other RNA-guided nucleases have been (or may in the future be) discovered or invented which utilize gRNAs that differ in some ways from those described to this point. For instance, Cpf1 ("CRISPR from Prevotella and Franciscella 1") is a recently discovered RNA-guided nuclease that does not require a tracrRNA to function. (Zetsche et al., 2015, Cell 163, 759-771 Oct. 22, 2015 (Zetsche I), incorporated by reference herein). A gRNA for use in a Cpf1 genome editing system generally includes a targeting domain and a complementarity domain (alternately referred to as a "handle"). It should also be noted that, in gRNAs for use with Cpf1, the targeting domain is usually present at or near the 3' end, rather than the 5' end as described above in connection with Cas9 gRNAs (the handle is at or near the 5' end of a Cpf1 gRNA).

Although structural differences may exist between gRNAs from different prokaryotic species, or between Cpf1 and Cas9 gRNAs, the principles by which gRNAs operate are generally consistent. Because of this consistency of operation, gRNAs can be defined, in broad terms, by their targeting domain sequences, and skilled artisans will appreciate that a given targeting domain sequence can be incorporated in any suitable gRNA, including a unimolecular or chimeric gRNA, or a gRNA that includes one or more chemical modifications and/or sequential modifications (substitutions, additional nucleotides, truncations, etc.). Thus, in some aspects in this disclosure, gRNAs may be described solely in terms of their targeting domain sequences.

More generally, some aspects of the present disclosure relate to systems, methods and compositions that can be implemented using multiple RNA-guided nucleases. Unless otherwise specified, the term gRNA should be understood to encompass any suitable gRNA that can be used with any RNA-guided nuclease, and not only those gRNAs that are compatible with a particular species of Cas9 or Cpf1. By way of illustration, the term gRNA can, in certain embodiments, include a gRNA for use with any RNA-guided nuclease occurring in a Class 2 CRISPR system, such as a type II or type V or CRISPR system, or an RNA-guided nuclease derived or adapted therefrom.

Certain exemplary modifications discussed in this section can be included at any position within a gRNA sequence including, without limitation at or near the 5' end (e.g., within 1-10, 1-5, or 1-2 nucleotides of the 5' end) and/or at or near the 3' end (e.g., within 1-10, 1-5, or 1-2 nucleotides of the 3' end). In some cases, modifications are positioned within functional motifs, such as the repeat-anti-repeat duplex of a Cas9 gRNA, a stem loop structure of a Cas9 or Cpf1 gRNA, and/or a targeting domain of a gRNA.

RNA-guided nucleases include, but are not limited to, naturally-occurring Class 2 CRISPR nucleases such as Cas9, and Cpf1, as well as other nucleases derived or obtained therefrom. In functional terms, RNA-guided nucleases are defined as those nucleases that: (a) interact with (e.g. complex with) a gRNA; and (b) together with the gRNA, associate with, and optionally cleave or modify, a target region of a DNA that includes (i) a sequence complementary to the targeting domain of the gRNA and, optionally, (ii) an additional sequence referred to as a "protospacer adjacent motif," or "PAM," which is described in greater detail below. As the following examples will illustrate, RNA-guided nucleases can be defined, in broad terms, by their PAM specificity and cleavage activity, even though variations may exist between individual RNA-guided nucleases that share the same PAM specificity or cleavage activity.

Skilled artisans will appreciate that some aspects of the present disclosure relate to systems, methods and compositions that can be implemented using any suitable RNA-guided nuclease having a certain PAM specificity and/or cleavage activity. For this reason, unless otherwise specified, the term RNA-guided nuclease should be understood as a generic term, and not limited to any particular type (e.g. Cas9 vs. Cpf1), species (e.g. *S. pyogenes* vs. *S. aureus*) or variation (e.g full-length vs. truncated or split; naturally-occurring PAM specificity vs. engineered PAM specificity, etc.) of RNA-guided nuclease.

In addition to recognizing specific sequential orientations of PAMs and protospacers, RNA-guided nucleases in some embodiments can also recognize specific PAM sequences. *S. aureus* Cas9, for instance, generally recognizes a PAM sequence of NNGRRT or NNGRRV, wherein the N residues are immediately 3' of the region recognized by the gRNA targeting domain. *S. pyogenes* Cas9 generally recognizes NGG PAM sequences. And *F. novicida* Cpf1 generally recognizes a TTN PAM sequence.

The crystal structure of *Acidaminococcus* sp. Cpf1 in complex with crRNA and a double-stranded (ds) DNA target including a TTTN PAM sequence has been solved by Yamano et al. (Cell. 2016 May 5; 165(4): 949-962 (Yamano), incorporated by reference herein). Cpf1, like Cas9, has two lobes: a REC (recognition) lobe, and a NUC (nuclease) lobe. The REC lobe includes REC1 and REC2 domains, which lack similarity to any known protein structures. The NUC lobe, meanwhile, includes three RuvC domains (RuvC-I, -II and -III) and a BH domain. However, in contrast to Cas9, the Cpf1 REC lobe lacks an HNH domain, and includes other domains that also lack similarity to known protein structures: a structurally unique PI domain, three Wedge (WED) domains (WED-I, -II and -III), and a nuclease (Nuc) domain.

While Cas9 and Cpf1 share similarities in structure and function, it should be appreciated that certain Cpf1 activities are mediated by structural domains that are not analogous to any Cas9 domains. For instance, cleavage of the complementary strand of the target DNA appears to be mediated by the Nuc domain, which differs sequentially and spatially from the HNH domain of Cas9. Additionally, the non-targeting portion of Cpf1 gRNA (the handle) adopts a pseudoknot structure, rather than a stem loop structure formed by the repeat:antirepeat duplex in Cas9 gRNAs.

Nucleic acids encoding RNA-guided nucleases, e.g., Cas9, Cpf1 or functional fragments thereof, are provided herein. Exemplary nucleic acids encoding RNA-guided nucleases have been described previously (see, e.g., Cong 2013; Wang 2013; *Mali* 2013; Jinek 2012).

3. Genome Editing Methods and Methods of Delivery a) Genome Editing Approaches

In general, it is to be understood that the alteration of any gene according to the methods described herein can be mediated by any mechanism and that any methods are not limited to a particular mechanism. Exemplary mechanisms that can be associated with the alteration of a gene include, but are not limited to, non-homologous end joining (e.g., classical or alternative), microhomology-mediated end joining (MMEJ), homology-directed repair (e.g., endogenous donor template mediated), synthesis dependent strand annealing (SDSA), single strand annealing, single strand invasion, single strand break repair (SSBR), mismatch repair (MMR), base excision repair (BER), Interstrand Crosslink (ICL) Translesion synthesis (TLS), or Error-free postreplication repair (PRR). Described herein are exemplary methods for targeted knockout of one or both alleles of one or all of TRAC, TRBC1 and/or TRBC2.

(1) NHEJ Approaches for Gene Targeting

As described herein, nuclease-induced non-homologous end joining (NHEJ) can be used to target gene-specific knockouts. Nuclease-induced NHEJ can also be used to remove (e.g., delete) sequence insertions in a gene of interest.

While not wishing to be bound by theory, it is believed that, in an embodiment, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein. The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can easily reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. In some embodiments, a pair of gRNAs can be used to introduce two double-strand breaks, resulting in a deletion of intervening sequences between the two breaks.

Both of these approaches can be used to delete specific DNA sequences; however, the error-prone nature of NHEJ may still produce indel mutations at the site of repair.

Both double strand cleaving eaCas9 molecules and single strand, or nickase, eaCas9 molecules can be used in the methods and compositions described herein to generate NHEJ-mediated indels. NHEJ-mediated indels targeted to the gene, e.g., a coding region, e.g., an early coding region of a gene, of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

In an embodiment, NHEJ-mediated indels are introduced into one or more T-cell expressed genes, such as TRAC, TRBC1 and/or TRBC2. Individual gRNAs or gRNA pairs targeting the gene are provided together with the Cas9 double-stranded nuclease or single-stranded nickase.

(2) Placement of Double Strand or Single Strand Breaks Relative to the Target Position In an embodiment, in which a gRNA and Cas9 nuclease generate a double strand break for the purpose of inducing NHEJ-mediated indels, a gRNA, e.g., a unimolecular (or chimeric) or modular gRNA molecule, is configured to position one double-strand break in close proximity to a nucleotide of the target position. In an embodiment, the cleavage site is between 0-30 bp away from the target position (e.g., less than 30, 25, 20, 15, 10, 9, 8, 7, 6, 5, 4, 3, 2 or 1 bp from the target position).

In an embodiment, in which two gRNAs complexing with Cas9 nickases induce two single strand breaks for the purpose of inducing NHEJ-mediated indels, two gRNAs, e.g., independently, unimolecular (or chimeric) or modular gRNA, are configured to position two single-strand breaks to provide for NHEJ repair a nucleotide of the target position. In an embodiment, the gRNAs are configured to position cuts at the same position, or within a few nucleotides of one another, on different strands, essentially mimicking a double strand break. In an embodiment, the closer nick is between 0-30 bp away from the target position (e.g., less than 30, 25, 20, 15, 10, 9, 8, 7, 6, 5, 4, 3, 2 or 1 bp from the target position), and the two nicks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of a nucleotide of the target position.

Both double strand cleaving eaCas9 molecules and single strand, or nickase, eaCas9 molecules can be used in the methods and compositions described herein to generate breaks both sides of a target position. Double strand or paired single strand breaks may be generated on both sides of a target position to remove the nucleic acid sequence between the two cuts (e.g., the region between the two breaks in deleted). In an embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a cas9 nuclease) and two single strand breaks or paired single stranded breaks (i.e., two gRNAs complex with Cas9 nickases) on either side of the target position. In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp).

(3) Targeted Knockdown

Unlike CRISPR/Cas-mediated gene knockout, which permanently eliminates or reduces expression by mutating the gene at the DNA level, CRISPR/Cas knockdown allows for temporary reduction of gene expression through the use of artificial transcription factors. Mutating key residues in both DNA cleavage domains of the Cas9 protein (e.g., the D10A and H840A mutations) results in the generation of a catalytically inactive Cas9 (eiCas9 which is also known as dead Cas9 or dCas9). A catalytically inactive Cas9 complexes with a gRNA and localizes to the DNA sequence specified by that gRNA's targeting domain, however, it does not cleave the target DNA. Fusion of the dCas9 to an effector domain, e.g., a transcription repression domain, enables recruitment of the effector to any DNA site specified by the gRNA. While it has been shown that the eiCas9 itself can block transcription when recruited to early regions in the coding sequence, more robust repression can be achieved by fusing a transcriptional repression domain (for example KRAB, SID or ERD) to the Cas9 and recruiting it to the promoter region of a gene. It is likely that targeting DNAseI hypersensitive regions of the promoter may yield more efficient gene repression or activation because these regions are more likely to be accessible to the Cas9 protein and are also more likely to harbor sites for endogenous transcription factors. Especially for gene repression, it is contemplated herein that blocking the binding site of an endogenous transcription factor would aid in downregulating gene expression. In another embodiment, an eiCas9 can be fused to a chromatin modifying protein. Altering chromatin status can result in decreased expression of the target gene.

In an embodiment, a gRNA molecule can be targeted to a known transcription response elements (e.g., promoters, enhancers, etc.), a known upstream activating sequences (UAS), and/or sequences of unknown or known function that are suspected of being able to control expression of the target DNA.

In an embodiment, CRISPR/Cas-mediated gene knockdown can be used to reduce expression one or more T-cell expressed genes. In an embodiment, in which a eiCas9 or an eiCas9 fusion protein described herein is used to knockdown two T-cell expressed genes, e.g., any two or more of TRAC, TRBC1 and/or TRBC2 genes, individual gRNAs or gRNA pairs targeting both or all genes are provided together with the eiCas9 or eiCas9 fusion protein.

(4) Single-Strand Annealing

Single strand annealing (SSA) is another DNA repair process that repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single strand overhangs containing the repeat sequences are coated with RPA protein to prevent the repeats sequences from inappropriate annealing, e.g., to themselves. RAD52 binds to and each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter or correct a target nucleic acid sequence. Instead, the complementary repeat sequence is utilized.

(5) Other DNA Repair Pathways (a) SSBR (Single Strand Break Repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott, Nature Reviews Genetics 9, 619-631 (August 2008), and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are 'damaged'. End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endoculease 1), DNA polymerase delta/epsilon, PCNA, and LIG1. There are two ways of gap filling, the short patch repair and the long patch repair. Short patch repair involves the insertion of a single nucleotide that is missing. At some SSBs, "gap filling" might continue displacing two or more nucleotides (displacement of up to 12 bases have been reported). FEN1 is an endonuclease that removes the displaced 5'-residues. Multiple DNA polymerases, including Pol β, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I.

Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase b, DNA polymerase d, DNA polymerase e, PCNA, LIG1, PNK, PNKP, APE1, APTX, APLF, TDP1, LIG3, FEN1, CtIP, MRN, and ERCC1.

(b) MMR (Mismatch Repair)

Cells contain three excision repair pathways: MMR, BER, and NER. The excision repair pathways have a common feature in that they typically recognize a lesion on one strand of the DNA, then exo/endonucleaseases remove the lesion and leave a 1-30 nucleotide gap that is sub-sequentially filled in by DNA polymerase and finally sealed with ligase. A more complete picture is given in Li, Cell Research (2008) 18:85-98, and a summary is provided here.

Mismatch repair (MMR) operates on mispaired DNA bases.

The MSH2/6 or MSH2/3 complexes both have ATPases activity that plays an important role in mismatch recognition and the initiation of repair. MSH2/6 preferentially recognizes base-base mismatches and identifies mispairs of 1 or 2 nucleotides, while MSH2/3 preferentially recognizes larger ID mispairs.

hMLH1 heterodimerizes with hPMS2 to form hMutLa which possesses an ATPase activity and is important for multiple steps of MMR. It possesses a PCNA/replication factor C (RFC)-dependent endonuclease activity which plays an important role in 3' nick-directed MMR involving EXO1. (EXO1 is a participant in both HR and MMR.) It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol d, RPA, HMGB1, RFC, and DNA ligase I.

(c) Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott, Nature Reviews Genetics 9, 619-631 (August 2008), and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends; (d) insertion of the correct nucleotide into the repair gap; and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incised the phosphodiester backbone to create a DNA single strand break (SSB). The third step of BER involves cleaning-up of the DNA ends. The fourth step in BER is conducted by Pol β that adds a new complementary nucleotide into the repair gap and in the final step XRCC1/Ligase III seals the remaining nick in the DNA backbone. This completes the short-patch BER pathway in which the majority (~80%) of damaged DNA bases are repaired. However, if the 5'-ends in step 3 are resistant to end processing activity, following one nucleotide insertion by Pol β there is then a polymerase switch to the replicative DNA polymerases, Pol δ/ε, which then add ~2-8 more nucleotides into the DNA repair gap. This creates a 5'-flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors that may promote the BER pathway include: DNA glycosylase, APE1, Polb, Pold, Pole, XRCC1, Ligase III, FEN-1, PCNA, RECQL4, WRN, MYH, PNKP, and APTX.

(d) Nucleotide Excision Repair (NER)

Nucleotide excision repair (NER) is an important excision mechanism that removes bulky helix-distorting lesions from DNA. Additional details about NER are given in Marteijn et al., Nature Reviews Molecular Cell Biology 15, 465-481 (2014), and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol δ, DNA Pol ε or DNA Pol κ, and DNA ligase I or XRCC1/Ligase III. Replicating cells tend to use DNA pol ε and DNA ligase I, while non-replicating cells tend to use DNA Pol δ, DNA Pol κ, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

(e) Intrastrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1), and the Fanconi anemia (FA) proteins, e.g., FancJ.

(f) Other Pathways

Several other DNA repair pathways exist in mammals.

Translesion synthesis (TLS) is a pathway for repairing a single stranded break left after a defective replication event and involves translesion polymerases, e.g., DNA polζ and Rev1.

Error-free postreplication repair (PRR) is another pathway for repairing a single stranded break left after a defective replication event.

(6) Examples of gRNAs in Genome Editing Methods

Any of the gRNA molecules as described herein can be used with any Cas9 molecules that generate a double strand break or a single strand break to alter the sequence of a target nucleic acid, e.g., a target position or target genetic signature. In some examples, the target nucleic acid is at or near the TRAC, TRBC1 and/or TRBC2 loci, such as any as described. In some embodiments, a ribonucleic acid molecule, such as a gRNA molecule, and a protein, such as a Cas9 protein or variants thereof, are introduced to any of the engineered cells provided herein. gRNA molecules useful in these methods are described below.

In an embodiment, the gRNA, e.g., a chimeric gRNA, is configured such that it comprises one or more of the following properties;
  a) it can position, e.g., when targeting a Cas9 molecule that makes double strand breaks, a double strand break (i) within 50, 100, 150, 200, 250, 300, 350, 400, 450, or 500 nucleotides of a target position, or (ii) sufficiently close that the target position is within the region of end resection;
  b) it has a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and
  c)
  (i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus*, or *N. meningitidis* tail and proximal domain, or a sequence that differs by no more than 1, 2, 3, 4, 5, 6, 7, 8, 9 or 10 nucleotides therefrom;
  (ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;
  (iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;
  (iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus*, or *N. meningitidis* tail domain, or a sequence that differs by no more than 1, 2, 3, 4, 5; 6, 7, 8, 9 or 10 nucleotides therefrom; or
  (v) the tail domain comprises 15, 20, 25, 30, 35, 40 nucleotides or all of the corresponding portions of a naturally occurring tail domain, e.g., a naturally occurring *S. pyogenes, S. thermophilus, S. aureus*, or *N. meningitidis* tail domain.

In an embodiment, the gRNA is configured such that it comprises properties: a and b(i). In an embodiment, the gRNA is configured such that it comprises properties: a and b(ii). In an embodiment, the gRNA is configured such that it comprises properties: a and b(iii). In an embodiment, the gRNA is configured such that it comprises properties: a and b(iv). In an embodiment, the gRNA is configured such that it comprises properties: a and b(v). In an embodiment, the gRNA is configured such that it comprises properties: a and b(vi). In an embodiment, the gRNA is configured such that it comprises properties: a and b(vii). In an embodiment, the gRNA is configured such that it comprises properties: a and b(viii). In an embodiment, the gRNA is configured such that it comprises properties: a and b(ix). In an embodiment, the gRNA is configured such that it comprises properties: a and b(x). In an embodiment, the gRNA is configured such that it comprises properties: a and b(xi). In an embodiment, the gRNA is configured such that it comprises properties: a and c. In an embodiment, the gRNA is configured such that in comprises properties: a, b, and c. In an embodiment, the gRNA is configured such that in comprises properties: a(i), b(i), and c(i). In an embodiment, the gRNA is configured such that in comprises properties: a(i), b(i), and c(ii). In an embodiment, the gRNA is configured such that in comprises properties: a(i), b(ii), and c(i). In an embodiment, the gRNA is configured such that in comprises properties: a(i), b(ii), and c(ii). In an embodiment, the gRNA is configured such that in comprises properties: a(i), b(iii), and c(i). In an embodiment, the gRNA is configured such that in comprises properties: a(i), b(iii), and c(ii). In an embodiment, the gRNA is configured such that in comprises properties: a(i), b(iv), and c(i). In an embodiment, the gRNA is configured such that in comprises properties: a(i), b(iv), and c(ii). In an embodiment, the gRNA is configured such that in comprises properties: a(i), b(v), and c(i). In an embodiment, the gRNA is configured such that in comprises properties: a(i), b(v), and c(ii). In an embodiment, the gRNA is configured such that in comprises properties: a(i), b(vi), and c(i). In an embodiment, the gRNA is configured such that in comprises properties: a(i), b(vi), and c(ii). In an embodiment, the gRNA is configured such that in comprises properties: a(i), b(vii), and c(i). In an embodiment, the gRNA is configured such that in comprises properties: a(i), b(vii), and c(ii). In an embodiment, the gRNA is configured such that in comprises properties: a(i), b(viii), and c(i). In an embodiment, the gRNA is configured such that in comprises properties: a(i), b(viii), and c(ii). In an embodiment, the gRNA is configured such that in comprises properties: a(i), b(ix), and c(i). In an embodiment, the gRNA is configured such that in comprises properties: a(i), b(ix), and c(ii). In an embodiment, the gRNA is configured such that in comprises properties: a(i), b(x), and c(i). In an embodiment, the gRNA is configured such that in comprises properties: a(i), b(x), and c(ii). In an embodiment, the gRNA is configured such that in comprises properties: a(i), b(xi), and c(i). In an embodiment, the gRNA is configured such that in comprises properties: a(i), b(xi), and c(ii).

In an embodiment, the gRNA, e.g., a chimeric gRNA, is configured such that it comprises one or more of the following properties;
a) one or both of the gRNAs can position, e.g., when targeting a Cas9 molecule that makes single strand breaks, a single strand break within (i) 50, 100, 150, 200, 250, 300, 350, 400, 450, or 500 nucleotides of a target position, or (ii) sufficiently close that the target position is within the region of end resection;
b) one or both have a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and
c)
(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus*, or *N. meningitidis* tail and proximal domain, or a sequence that differs by no more than 1, 2, 3, 4, 5; 6, 7, 8, 9 or 10 nucleotides therefrom;
(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;
(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;
(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus*, or *N. meningitidis* tail domain, or a sequence that differs by no more than 1, 2, 3, 4, 5; 6, 7, 8, 9 or 10 nucleotides therefrom; or
(v) the tail domain comprises 15, 20, 25, 30, 35, 40 nucleotides or all of the corresponding portions of a naturally occurring tail domain, e.g., a naturally occurring *S. pyogenes, S. thermophilus, S. aureus*, or *N. meningitidis* tail domain.

In an embodiment, the gRNA is configured such that it comprises properties: a and b(i). In an embodiment, the gRNA is configured such that it comprises properties: a and b(ii). In an embodiment, the gRNA is configured such that it comprises properties: a and b(iii). In an embodiment, the gRNA is configured such that it comprises properties: a and b(iv). In an embodiment, the gRNA is configured such that it comprises properties: a and b(v). In an embodiment, the gRNA is configured such that it comprises properties: a and b(vi). In an embodiment, the gRNA is configured such that it comprises properties: a and b(vii). In an embodiment, the gRNA is configured such that it comprises properties: a and b(viii). In an embodiment, the gRNA is configured such that it comprises properties: a and b(ix). In an embodiment, the gRNA is configured such that it comprises properties: a and b(x). In an embodiment, the gRNA is configured such that it comprises properties: a and b(xi). In an embodiment, the gRNA is configured such that it comprises properties: a and c. In an embodiment, the gRNA is configured such that in comprises properties: a, b, and c. In an embodiment, the gRNA is configured such that in comprises properties: a(i), b(i), and c(i). In an embodiment, the gRNA is configured such that in comprises properties: a(i), b(i), and c(ii). In an embodiment, the gRNA is configured such that in comprises properties: a(i), b(ii), and c(i). In an embodiment, the gRNA is configured such that in comprises properties: a(i), b(ii), and c(ii). In an embodiment, the gRNA is configured such that in comprises properties: a(i), b(iii), and c(i). In an embodiment, the gRNA is configured such that in comprises properties: a(i), b(iii), and c(ii). In an embodiment, the gRNA is configured such that in comprises properties: a(i), b(iv), and c(i). In an embodiment, the gRNA is configured such that in comprises properties: a(i), b(iv), and c(ii). In an embodiment, the gRNA is configured such that in comprises properties: a(i), b(v), and c(i). In an embodiment, the gRNA is configured such that in comprises properties: a(i), b(v), and c(ii). In an embodiment, the gRNA is configured such that in comprises properties: a(i), b(vi), and c(i). In an embodiment, the gRNA is configured such that in comprises properties: a(i), b(vi), and c(ii). In an embodiment, the gRNA is configured such that in comprises properties: a(i), b(vii), and c(i). In an embodiment, the gRNA is configured such that in comprises properties: a(i), b(vii), and c(ii). In an embodiment, the gRNA is configured such that in comprises properties: a(i), b(viii), and c(i). In an embodiment, the gRNA is configured such that in comprises properties: a(i), b(viii), and c(ii). In an embodiment, the gRNA is configured such that in comprises properties: a(i), b(ix), and c(i). In an embodiment, the gRNA is configured such that in comprises properties: a(i), b(ix), and c(ii). In an embodiment, the gRNA is configured such that in comprises properties: a(i), b(x), and c(i). In an embodiment, the gRNA is configured such that in comprises properties: a(i), b(x), and c(ii). In an embodiment, the gRNA is configured such that in comprises properties: a(i), b(xi), and c(i). In an embodiment, the gRNA is configured such that in comprises properties: a(i), b(xi), and c(ii).

In an embodiment, the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at H840, e.g., a H840A.

In an embodiment, a pair of gRNAs, e.g., a pair of chimeric gRNAs, comprising a first and a second gRNA, is configured such that they comprises one or more of the following properties;
a) one or both of the gRNAs can position, e.g., when targeting a Cas9 molecule that makes single strand breaks, a single strand break within (i) 50, 100, 150, 200, 250, 300, 350, 400, 450, or 500 nucleotides of a target position, or (ii) sufficiently close that the target position is within the region of end resection;
b) one or both have a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides;

c) for one or both:
(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus*, or *N. meningitidis* tail and proximal domain, or a sequence that differs by no more than 1, 2, 3, 4, 5; 6, 7, 8, 9 or 10 nucleotides therefrom;
(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;
(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;
(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus*, or *N. meningitidis* tail domain; or, a sequence that differs by no more than 1, 2, 3, 4, 5; 6, 7, 8, 9 or 10 nucleotides therefrom; or
(v) the tail domain comprises 15, 20, 25, 30, 35, 40 nucleotides or all of the corresponding portions of a naturally occurring tail domain, e.g., a naturally occurring *S. pyogenes, S. thermophilus, S. aureus*, or *N. meningitidis* tail domain;

d) the gRNAs are configured such that, when hybridized to target nucleic acid, they are separated by 0-50, 0-100, 0-200, at least 10, at least 20, at least 30 or at least 50 nucleotides;

e) the breaks made by the first gRNA and second gRNA are on different strands; and f) the PAMs are facing outwards.

In an embodiment, one or both of the gRNAs is configured such that it comprises properties: a and b(i). In an embodiment, one or both of the gRNAs is configured such that it comprises properties: a and b(ii). In an embodiment, one or both of the gRNAs is configured such that it comprises properties: a and b(iii). In an embodiment, one or both of the gRNAs is configured such that it comprises properties: a and b(iv). In an embodiment, one or both of the gRNAs is configured such that it comprises properties: a and b(v). In an embodiment, one or both of the gRNAs is configured such that it comprises properties: a and b(vi). In an embodiment, one or both of the gRNAs is configured such that it comprises properties: a and b(vii). In an embodiment, one or both of the gRNAs is configured such that it comprises properties: a and b(viii). In an embodiment, one or both of the gRNAs is configured such that it comprises properties: a and b(ix). In an embodiment, one or both of the gRNAs is configured such that it comprises properties: a and b(x). In an embodiment, one or both of the gRNAs is configured such that it comprises properties: a and b(xi). In an embodiment, one or both of the gRNAs configured such that it comprises properties: a and c. In an embodiment, one or both of the gRNAs is configured such that it comprises properties: a, b, and c. In an embodiment, one or both of the gRNAs is configured such that it comprises properties: a(i), b(i), and c(i). In an embodiment, one or both of the gRNAs is configured such that it comprises properties: a(i), b(i), and c(ii). In an embodiment, one or both of the gRNAs is configured such that it comprises properties: a(i), b(i), c, and d. In an embodiment, one or both of the gRNAs is configured such that it comprises properties: a(i), b(i), c, and e. In an embodiment, one or both of the gRNAs is configured such that it comprises properties: a(i), b(i), c, d, and e. In an embodiment, one or both of the gRNAs is configured such that it comprises properties: a(i), b(ii), and c(i). In an embodiment, one or both of the gRNAs is configured such that it comprises properties: a(i), b(ii), and c(ii). In an embodiment, one or both of the gRNAs is configured such that it comprises properties: a(i), b(ii), c, and d. In an embodiment, one or both of the gRNAs is configured such that it comprises properties: a(i), b(ii), c, and e. In an embodiment, one or both of the gRNAs is configured such that it comprises properties: a(i), b(ii), c, d, and e. In an embodiment, one or both of the gRNAs is configured such that it comprises properties: a(i), b(iii), and c(i). In an embodiment, one or both of the gRNAs is configured such that it comprises properties: a(i), b(iii), and c(ii). In an embodiment, one or both of the gRNAs is configured such that it comprises properties: a(i), b(iii), c, and d. In an embodiment, one or both of the gRNAs is configured such that it comprises properties: a(i), b(iii), c, and e. In an embodiment, one or both of the gRNAs is configured such that it comprises properties: a(i), b(iii), c, d, and e. In an embodiment, one or both of the gRNAs is configured such that it comprises properties: a(i), b(iv), and c(i). In an embodiment, one or both of the gRNAs is configured such that it comprises properties: a(i), b(iv), and c(ii). In an embodiment, one or both of the gRNAs is configured such that it comprises properties: a(i), b(iv), c, and d. In an embodiment, one or both of the gRNAs is configured such that it comprises properties: a(i), b(iv), c, and e. In an embodiment, one or both of the gRNAs is configured such that it comprises properties: a(i), b(iv), c, d, and e. In an embodiment, one or both of the gRNAs is configured such that it comprises properties: a(i), b(v), and c(i). In an embodiment, one or both of the gRNAs is configured such that it comprises properties: a(i), b(v), and c(ii). In an embodiment, one or both of the gRNAs is configured such that it comprises properties: a(i), b(v), c, and d. In an embodiment, one or both of the gRNAs is configured such that it comprises properties: a(i), b(v), c, and e. In an embodiment, one or both of the gRNAs is configured such that it comprises properties: a(i), b(v), c, d, and e. In an embodiment, one or both of the gRNAs is configured such that it comprises properties: a(i), b(vi), and c(i). In an embodiment, one or both of the gRNAs is configured such that it comprises properties: a(i), b(vi), and c(ii). In an embodiment, one or both of the gRNAs is configured such that it comprises properties: a(i), b(vi), c, and d. In an embodiment, one or both of the gRNAs is configured such that it comprises properties: a(i), b(vi), c, and e. In an embodiment, one or both of the gRNAs is configured such that it comprises properties: a(i), b(vi), c, d, and e. In an embodiment, one or both of the gRNAs is configured such that it comprises properties: a(i), b(vii), and c(i). In an embodiment, one or both of the gRNAs is configured such that it comprises properties: a(i), b(vii), and c(ii). In an embodiment, one or both of the gRNAs is configured such that it comprises properties: a(i), b(vii), c, and d. In an embodiment, one or both of the gRNAs is configured such that it comprises properties: a(i), b(vii), c, and e. In an embodiment, one or both of the gRNAs is configured such that it comprises properties: a(i), b(vii), c, d, and e. In an embodiment, one or both of the gRNAs is configured such that it comprises properties: a(i), b(viii), and c(i). In an embodiment, one or both of the gRNAs is configured such that it comprises properties: a(i), b(viii), and c(ii). In an embodiment, one or both of the gRNAs is configured such that it comprises properties: a(i), b(viii), c, and d. In an embodiment, one or both of the gRNAs is configured such that it comprises properties: a(i), b(viii), c, and e. In an embodiment, one or both of the gRNAs is configured such that it comprises properties: a(i), b(viii), c, d, and e. In an embodiment, one or both of the gRNAs is configured such that it comprises properties: a(i), b(ix), and c(i). In an embodiment, one or both of the gRNAs is configured such that it comprises properties: a(i), b(ix), and c(ii). In an embodiment, one or both of the gRNAs is configured such that it comprises properties: a(i), b(ix), c, and d. In an embodiment, one or both of the gRNAs is configured such that it comprises properties: a(i), b(ix), c, and e. In an embodiment, one or both of the gRNAs is configured such that it comprises properties: a(i), b(ix), c, d, and e. In an embodiment, one or both of the gRNAs is configured such that it comprises properties: a(i), b(x), and c(i). In an embodiment, one or both of the gRNAs is configured such that it comprises properties: a(i), b(x), and c(ii). In an embodiment, one or both of the gRNAs is configured such that it comprises properties: a(i), b(x), c, and d. In an embodiment, one or both of the gRNAs is configured such that it comprises properties: a(i), b(x), c, and e. In an embodiment, one or both of the gRNAs is configured such that it comprises properties: a(i), b(x), c, d, and e. In an embodiment, one or both of the gRNAs is configured such that it comprises properties: a(i), b(xi), and c(i). In an embodiment, one or both of the gRNAs is configured such that it comprises properties: a(i), b(xi), and c(ii). In an embodiment, one or both of the gRNAs is configured such that it comprises properties: a(i), b(xi), c, and d. In an embodiment, one or both of the gRNAs is configured such that it comprises properties: a(i), b(xi), c, and e. In an embodiment, one or both of the gRNAs is configured such that it comprises properties: a(i), b(xi), c, d, and e.

In an embodiment, the gRNAs are used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNAs are used with a Cas9 nickase molecule having RuvC activity, e.g., a Cas9 molecule having the HNH activity inactivated, e.g., a Cas9 molecule having a mutation at H840, e.g., a H840A. In an embodiment, the gRNAs are used with a Cas9 nickase molecule having RuvC activity, e.g., a Cas9 molecule having the HNH activity inactivated, e.g., a Cas9 molecule having a mutation at N863, e.g., N863A.

(7) Functional Analysis of Agents for Gene Editing

Any of the Cas9 molecules, gRNA molecules, Cas9 molecule/gRNA molecule complexes, can be evaluated by art-known methods or as described herein. For example, exemplary methods for evaluating the endonuclease activity of Cas9 molecule are described, e.g., in Jinek et al., SCIENCE 2012, 337(6096):816-821.

(a) Binding and Cleavage Assay: Testing the Endonuclease Activity of Cas9 Molecule The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and –3-6 pmol (~20-40 mCi) [γ-32P]-ATP in 1× T4 polynucleotide kinase reaction buffer at 37° C. for 30 min, in a 50 μL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 μl. Reactions are initiated by the addition of 1 μl target DNA (10 nM) and incubated for 1 h at 37° C. Reactions are quenched by the addition of 20 μl of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of any of the gRNA molecule or Cas9 molecule provided.

(b) Binding Assay: Testing the Binding of Cas9 Molecule to Target DNA

Exemplary methods for evaluating the binding of Cas9 molecule to target DNA are described, e.g., in Jinek et al., SCIENCE 2012; 337(6096):816-821.

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1×TBE. DNA bands are visualized by UV shadowing, excised, and eluted by soaking gel pieces in DEPC-treated $H_2O$. Eluted DNA is ethanol precipitated and dissolved in DEPC-treated $H_2O$. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM $MgCl_2$, 1 mM DTT and 10% glycerol in a total volume of 10 µl. Cas9 protein molecule is programmed with equimolar amounts of pre-annealed gRNA molecule and titrated from 100 pM to 1 µM. Radiolabeled DNA is added to a final concentration of 20 pM. Samples are incubated for 1 h at 37° C. and resolved at 4° C. on an 8% native polyacrylamide gel containing 1×TBE and 5 mM $MgCl_2$. Gels are dried and DNA visualized by phosphorimaging.

(c) Techniques for Measuring Thermostability of Cas9/gRNA Complexes

The thermostability of Cas9-gRNA ribonucleoprotein (RNP) complexes can be detected by differential scanning fluorimetry (DSF) and other techniques. The thermostability of a protein can increase under favorable conditions such as the addition of a binding RNA molecule, e.g., a gRNA. Thus, information regarding the thermostability of a Cas9/gRNA complex is useful for determining whether the complex is stable.

(d) Differential Scanning Flourimetry (DSF)

The thermostability of Cas9-gRNA ribonucleoprotein (RNP) complexes can be measured via DSF. RNP complexes, as described below, include a sequence of ribonucleotides, such as an RNA or a gRNA, and a protein, such as a Cas9 protein or variant thereof. This technique measures the thermostability of a protein, which can increase under favorable conditions such as the addition of a binding RNA molecule, e.g., a gRNA.

The assay can be applied in a number of ways. Exemplary protocols include, but are not limited to, a protocol to determine the desired solution conditions for RNP formation (assay 1, see below), a protocol to test the desired stoichiometric ratio of gRNA:Cas9 protein (assay 2, see below), a protocol to screen for effective gRNA molecules for Cas9 molecules, e.g., wild-type or mutant Cas9 molecules (assay 3, see below), and a protocol to examine RNP formation in the presence of target DNA (assay 4). In some embodiments, the assay is performed using two different protocols, one to test the best stoichiometric ratio of gRNA:Cas9 protein and another to determine the best solution conditions for RNP formation.

To determine the best solution to form RNP complexes, a 2 uM solution of Cas9 in water+10× SYPRO Orange® (Life Technologies cat #S-6650) and dispensed into a 384 well plate. An equimolar amount of gRNA diluted in solutions with varied pH and salt is then added. After incubating at room temperature for 10' and brief centrifugation to remove any bubbles, a Bio-Rad CFX384TM Real-Time System C1000 Touch™ Thermal Cycler with the Bio-Rad CFX Manager software is used to run a gradient from 20° C. to 90° C. with a 1° increase in temperature every 10 seconds.

The second assay consists of mixing various concentrations of gRNA with 2 uM Cas9 in optimal buffer from assay 1 above and incubating at RT for 10' in a 384 well plate. An equal volume of optimal buffer+10× SYPRO Orange® (Life Technologies cat #S-6650) is added and the plate sealed with Microseal® B adhesive (MSB-1001). Following brief centrifugation to remove any bubbles, a Bio-Rad CFX384TM Real-Time System C1000 Touch™ Thermal Cycler with the Bio-Rad CFX Manager software is used to run a gradient from 20° C. to 90° C. with a 1° increase in temperature every 10 seconds.

In the third assay, a Cas9 molecule (e.g., a Cas9 protein, e.g., a Cas9 variant protein) of interest is purified. A library of variant gRNA molecules is synthesized and resuspended to a concentration of 20 µM. The Cas9 molecule is incubated with the gRNA molecule at a final concentration of 1 µM each in a predetermined buffer in the presence of 5× SYPRO Orange® (Life Technologies cat #S-6650). After incubating at room temperature for 10 minutes and centrifugation at 2000 rpm for 2 minutes to remove any bubbles, a Bio-Rad CFX384™ Real-Time System C1000 Touch™ Thermal Cycler with the Bio-Rad CFX Manager software is used to run a gradient from 20° C. to 90° C. with an increase of 1° C. in temperature every 10 seconds.

In the fourth assay, a DSF experiment is performed with the following samples: Cas9 protein alone, Cas9 protein with gRNA, Cas9 protein with gRNA and target DNA, and Cas9 protein with target DNA. The order of mixing components is: reaction solution, Cas9 protein, gRNA, DNA, and SYPRO Orange. The reaction solution contains 10 mM HEPES pH 7.5, 100 mM NaCl, in the absence or presence of MgCl2. Following centrifugation at 2000 rpm for 2 minutes to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

b) Delivery of Agents for Gene Editing

In some embodiments, a reduction, deletion, elimination, knockout or disruption of the endogenous genes encoding TCR, such as TRAC and TRBC1 or TRBC2, is carried out by delivering or introducing one or more agent(s) capable of introducing a cleavage, e.g., Cas9 and/or gRNA components, to a cell, using any of a number of known delivery method or vehicle for introduction or transfer to cells, for example, using lentiviral delivery vectors, or any of the known methods or vehicles for delivering Cas9 molecules and gRNAs. Exemplary methods are described in, e.g., Wang et al. (2012) *J. Immunother.* 35(9): 689-701; Cooper et al. (2003) *Blood.* 101:1637-1644; Verhoeyen et al. (2009) *Methods Mol Biol.* 506: 97-114; and Cavalieri et al. (2003) *Blood.* 102(2): 497-505, WO 2015/161276; US 2015/0056705, US 2016/0272999, US 2017/0211075; or US 2017/0016027. In some embodiments, nucleic acid sequences encoding one or more components of one or more agent(s) capable of introducing a cleavage, e.g., DNA break, is introduced into the cells, e.g., by any methods for introducing nucleic acids into a cell described herein or known. In some embodiments, a vector encoding components of one or more agent(s) capable of introducing a cleavage such as a CRISPR guide RNA and/or a Cas9 enzyme can be delivered into the cell.

Cas9 molecules and gRNA molecules, e.g., a Cas9 molecule/gRNA molecule complex, can be used to manipulate a cell, e.g., to edit a target nucleic acid, in a wide variety of cells.

In an embodiment, a cell is manipulated by editing (e.g., inducing a mutation in) one or more target genes, e.g., as described herein. In some embodiments, the expression of one or more target genes (e.g., TRAC, TRBC1 and/or TRBC2 gene) is modulated. In another embodiment, a cell is manipulated ex vivo by editing (e.g., inducing a mutation in) one or more target genes and/or modulating the expression of one or more target genes, e.g., TRAC, TRBC1 and/or TRBC2 gene, and administered to a subject. Sources of target cells for ex vivo manipulation may include, e.g., the subject's blood, the subject's cord blood, or the subject's bone marrow. Sources of target cells for ex vivo manipulation may also include, e.g., heterologous donor blood, cord blood, or bone marrow.

The Cas9 and gRNA molecules described herein can be delivered to a target cell. In an embodiment, the target cell is a T cell, e.g., a CD8+ T cell (e.g., a CD8+naïve T cell, central memory T cell, or effector memory T cell), a CD4+ T cell, a natural killer T cell (NKT cells), a regulatory T cell (Treg), a stem cell memory T cell, a lymphoid progenitor cell a hematopoietic stem cell, a natural killer cell (NK cell) or a dendritic cell. In an embodiment, the target cell is an induced pluripotent stem (iPS) cell or a cell derived from an iPS cell, e.g., an iPS cell generated from a subject, manipulated to alter (e.g., induce a mutation in) or manipulate the expression of one or more target genes, e.g., TRAC, TRBC1 and/or TRBC2 gene, and differentiated into, e.g., a T cell, e.g., a CD8+ T cell (e.g., a CD8+naïve T cell, central memory T cell, or effector memory T cell), a CD4+ T cell, a stem cell memory T cell, a lymphoid progenitor cell or a hematopoietic stem cell.

In an embodiment, the target cell has been altered to contain specific T cell receptor (TCR) genes (e.g., a TRAC and TRBC gene). In another embodiment, the TCR has binding specificity for a tumor associated antigen, e.g., carcinoembryonic antigen (CEA), GP100, melanoma antigen recognized by T cells 1 (MART1), melanoma antigen A3 (MAGEA3), NYESO1 or p53.

In an embodiment, the target cell has been altered to contain a specific chimeric antigen receptor (CAR). In an embodiment, the CAR has binding specificity for a tumor associated antigen, e.g., CD19, CD20, carbonic anhydrase IX (CAIX), CD171, CEA, ERBB2, GD2, alpha-folate receptor, Lewis Y antigen, prostate specific membrane antigen (PSMA) or tumor associated glycoprotein 72 (TAG72).

In another embodiment, the target cell has been altered to bind one or more of the following tumor antigens, e.g., by a TCR or a CAR. Tumor antigens may include, but are not limited to, AD034, AKT1, BRAP, CAGE, CDX2, CLP, CT-7, CT8/HOM-TES-85, cTAGE-1, Fibulin-1, HAGE, HCA587/MAGE-C2, hCAP-G, HCE661, HER2/neu, HLA-Cw, HOM-HD-21/Galectin9, HOM-MEEL-40/SSX2, HOM-RCC-3.1.3/CAXII, HOXA7, HOXB6, Hu, HUB1, KM-HN-3, KM-KN-1, KOC1, KOC2, KOC3, KOC3, LAGE-1, MAGE-1, MAGE-4a, MPP11, MSLN, NNP-1, NY-BR-1, NY-BR-62, NY-BR-85, NY-CO-37, NY-CO-38, NY-ESO-1, NY-ESO-5, NY-LU-12, NY-REN-10, NY-REN-19/LKB/STK11, NY-REN-21, NY-REN-26/BCR, NY-REN-3/NY-CO-38, NY-REN-33/SNC6, NY-REN-43, NY-REN-65, NY-REN-9, NY-SAR-35, OGFr, PLU-1, Rab38, RBPJkappa, RHAMM, SCP1, SCP-1, SSX3, SSX4, SSX5, TOP2A, TOP2B, or Tyrosinase.

(1) Methods of Ex Vivo Delivery of Components to Target Cells

The components, e.g., a Cas9 molecule and gRNA molecule can be introduced into target cells in a variety of forms using a variety of delivery methods and formulations, see, e.g., Tables 19 and 20. When a Cas9 or gRNA component is encoded as DNA for delivery, the DNA may typically but not necessarily include a control region, e.g., comprising a promoter, to effect expression. Useful promoters for Cas9 molecule sequences include, e.g., CMV, EF-1a, EFS, MSCV, PGK, or CAG promoters. Useful promoters for gRNAs include, e.g., H1, EF-1a, tRNA or U6 promoters. Promoters with similar or dissimilar strengths can be selected to tune the expression of components. Sequences encoding a Cas9 molecule may comprise a nuclear localization signal (NLS), e.g., an SV40 NLS. In an embodiment a promoter for a Cas9 molecule or a gRNA molecule may be, independently, inducible, tissue specific, or cell specific. In some embodiments, an agent capable of inducing a genetic disruption is introduced RNP complexes. RNP complexes include a sequence of ribonucleotides, such as an RNA or a gRNA molecule, and a protein, such as a Cas9 protein or variant thereof. In some embodiments, the Cas9 protein is delivered as a ribonucleoprotein (RNP) complex that comprises a Cas9 protein provided herein and a gRNA molecule provided herein, e.g., a gRNA targeted for TRAC, TRBC1 and/or TRBC2. In some embodiments, the RNP that includes one or more gRNA molecules targeted for TRAC, TRBC1 and/or TRBC2, such as any as described, and a Cas9 enzyme or variant thereof, is directly introduced into the cell via physical delivery (e.g., electroporation, particle gun, Calcium Phosphate transfection, cell compression or squeezing), liposomes or nanoparticles. In particular embodiments, the RNP includes one or more gRNA molecules targeted for TRAC, TRBC1 and/or TRBC2 and a Cas9 enzyme or variant thereof is introduced via electroporation.

Table 19 provides examples of the form in which the components can be delivered to a target cell.

TABLE 19

Exemplary Delivery Methods

| Elements | | |
| --- | --- | --- |
| Cas9 Molecule(s) | gRNA molecule(s) | Comments |
| DNA | DNA | In this embodiment, a Cas9 molecule and a gRNA are transcribed from DNA. In this embodiment, they are encoded on separate molecules. |
| | DNA | In this embodiment, a Cas9 molecule and a gRNA are transcribed from DNA, here from a single molecule. |
| DNA | RNA | In this embodiment, a Cas9 molecule is transcribed from DNA, and a gRNA is provided as in vitro transcribed or synthesized RNA |
| mRNA | RNA | In this embodiment, a Cas9 molecule is translated from in vitro transcribed mRNA, and a gRNA is provided as in vitro transcribed or synthesized RNA. |

TABLE 19-continued

Exemplary Delivery Methods

| Elements | | |
|---|---|---|
| Cas9 Molecule(s) | gRNA molecule(s) | Comments |
| mRNA | DNA | In this embodiment, a Cas9 molecule is translated from in vitro transcribed mRNA, and a gRNA is transcribed from DNA. |
| Protein | DNA | In this embodiment, a Cas9 molecule is provided as a protein, and a gRNA is transcribed from DNA. |
| Protein | RNA | In this embodiment, a Cas9 molecule is provided as a protein, and a gRNA is provided as transcribed or synthesized RNA. |

Table 20 summarizes various delivery methods for the components of a Cas system, e.g., the Cas9 molecule component and the gRNA molecule component, as described herein.

TABLE 20

Comparison of Exemplary Delivery Methods

| Delivery Vector/Mode | | Delivery into Non-Dividing Cells | Duration of Expression | Genome Integration | Type of Molecule Delivered |
|---|---|---|---|---|---|
| Physical (e.g., electroporation, particle gun, Calcium Phosphate transfection, cell compression or squeezing) | | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

(a) DNA-Based Delivery of a Cas9 Molecule and/or a gRNA Molecule

DNA encoding Cas9 molecules (e.g., eaCas9 molecules) and/or gRNA molecules, can be delivered into cells by art-known methods or as described herein. For example, Cas9-encoding and/or gRNA-encoding DNA can be delivered, e.g., by vectors (e.g., viral or non-viral vectors), non-vector based methods (e.g., using naked DNA or DNA complexes), or a combination thereof.

In some embodiments, the Cas9- and/or gRNA-encoding DNA is delivered by a vector (e.g., viral vector/virus or plasmid).

A vector may comprise a sequence that encodes a Cas9 molecule and/or a gRNA molecule. A vector may also comprise a sequence encoding a signal peptide (e.g., for nuclear localization, nucleolar localization, mitochondrial localization), fused, e.g., to a Cas9 molecule sequence. For example, a vector may comprise a nuclear localization sequence (e.g., from SV40) fused to the sequence encoding the Cas9 molecule.

One or more regulatory/control elements, e.g., a promoter, an enhancer, an intron, a polyadenylation signal, a Kozak consensus sequence, internal ribosome entry sites (IRES), a 2A sequence, and splice acceptor or donor can be included in the vectors. In an embodiment, the promoter is recognized by RNA polymerase II (e.g., a CMV promoter). In another embodiment, the promoter is recognized by RNA polymerase III (e.g., a U6 promoter). In another embodiment, the promoter is a regulated promoter (e.g., inducible promoter). In another embodiment, the promoter is a constitutive promoter. In another embodiment, the promoter is a tissue specific promoter. In another embodiment, the promoter is a viral promoter. In another embodiment, the promoter is a non-viral promoter.

In an embodiment, the vector or delivery vehicle is a viral vector (e.g., for generation of recombinant viruses). In an embodiment, the virus is a DNA virus (e.g., dsDNA or ssDNA virus). In an embodiment, the virus is an RNA virus (e.g., an ssRNA virus). Exemplary viral vectors/viruses include, e.g., retroviruses, lentiviruses, adenovirus, adeno-associated virus (AAV), vaccinia viruses, poxviruses, and herpes simplex viruses.

In an embodiment, the virus infects dividing cells. In another embodiment, the virus infects non-dividing cells. In another embodiment, the virus infects both dividing and non-dividing cells. In another embodiment, the virus can integrate into the host genome. In another embodiment, the virus is engineered to have reduced immunity, e.g., in human. In another embodiment, the virus is replication-competent. In another embodiment, the virus is replication-defective, e.g., having one or more coding regions for the genes necessary for additional rounds of virion replication and/or packaging replaced with other genes or deleted. In another embodiment, the virus causes transient expression of the Cas9 molecule and/or the gRNA molecule. In another embodiment, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In an embodiment, the Cas9- and/or gRNA-encoding DNA is delivered by a recombinant retrovirus. In another embodiment, the retrovirus (e.g., Moloney murine leukemia virus) comprises a reverse transcriptase, e.g., that allows integration into the host genome. In an embodiment, the retrovirus is replication-competent. In another embodiment, the retrovirus is replication-defective, e.g., having one of more coding regions for the genes necessary for additional rounds of virion replication and packaging replaced with other genes, or deleted.

In an embodiment, the Cas9- and/or gRNA-encoding DNA is delivered by a recombinant lentivirus. For example, the lentivirus is replication-defective, e.g., does not comprise one or more genes required for viral replication.

In an embodiment, the Cas9- and/or gRNA-encoding DNA is delivered by a recombinant adenovirus. In another embodiment, the adenovirus is engineered to have reduced immunity in humans.

In an embodiment, the Cas9- and/or gRNA-encoding DNA is delivered by a recombinant AAV. In an embodiment, the AAV can incorporate its genome into that of a host cell, e.g., a target cell as described herein. In another embodiment, the AAV is a self-complementary adeno-associated virus (scAAV), e.g., a scAAV that packages both strands which anneal together to form double stranded DNA. AAV serotypes that may be used in the disclosed methods, include AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV 8.2, AAV9, AAV rh 10, and pseudotyped AAV, such as AAV2/8, AAV2/5 and AAV2/6 can also be used in the disclosed methods.

In an embodiment, the Cas9- and/or gRNA-encoding DNA is delivered by a hybrid virus, e.g., a hybrid of one or more of the viruses described herein.

A packaging cell is used to form a virus particle that is capable of infecting a target cell. Such a cell includes a 293 cell, which can package adenovirus, and a ψ2 cell or a PA317 cell, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed, eg. Cas9. For example, an AAV vector used in gene therapy typically only possesses inverted terminal repeat (ITR) sequences from the AAV genome which are required for packaging and gene expression in the host or target cell. The missing viral functions are supplied in trans by the packaging cell line. Henceforth, the viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV.

In an embodiment, the viral vector has the ability of cell type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, a single chain antibody, a growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In an embodiment, the viral vector achieves cell type specific expression. For example, a tissue-specific promoter can be constructed to restrict expression of the transgene (Cas 9 and gRNA) in only a specific target cell. The specificity of the vector can also be mediated by microRNA-dependent control of transgene expression. In an embodiment, the viral vector has increased efficiency of fusion of the viral vector and a target cell membrane. For example, a fusion protein such as fusion-competent hemagglutinin (HA) can be incorporated to increase viral uptake into cells. In an embodiment, the viral vector has the ability of nuclear localization. For example, a virus that requires the breakdown of the nuclear membrane (during cell division) and therefore will not infect a non-diving cell can be altered to incorporate a nuclear localization peptide in the matrix protein of the virus thereby enabling the transduction of non-proliferating cells.

In an embodiment, the Cas9- and/or gRNA-encoding DNA is delivered by a non-vector based method (e.g., using naked DNA or DNA complexes). For example, the DNA can be delivered, e.g., by organically modified silica or silicate (Ormosil), electroporation, transient cell compression or squeezing (e.g., as described in Lee, et al [2012] *Nano Lett* 12: 6322-27), gene gun, sonoporation, magnetofection, lipid-mediated transfection, dendrimers, inorganic nanoparticles, calcium phosphates, or a combination thereof.

In an embodiment, delivery via electroporation comprises mixing the cells with the Cas9- and/or gRNA-encoding DNA in a cartridge, chamber or cuvette and applying one or more electrical impulses of defined duration and amplitude. In an embodiment, delivery via electroporation is performed using a system in which cells are mixed with the Cas9- and/or gRNA-encoding DNA in a vessel connected to a device (e.g., a pump) which feeds the mixture into a cartridge, chamber or cuvette wherein one or more electrical impulses of defined duration and amplitude are applied, after which the cells are delivered to a second vessel.

In an embodiment, the Cas9- and/or gRNA-encoding DNA is delivered by a combination of a vector and a non-vector based method. For example, a virosome comprises a liposome combined with an inactivated virus (e.g., HIV or influenza virus), which can result in more efficient gene transfer than either a viral or a liposomal method alone.

In an embodiment, the delivery vehicle is a non-viral vector. In an embodiment, the non-viral vector is an inorganic nanoparticle. Exemplary inorganic nanoparticles include, e.g., magnetic nanoparticles (e.g., $Fe_3MnO_2$) and silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle. Exemplary organic nanoparticles include, e.g., SNALP liposomes that contain cationic lipids together with neutral helper lipids which are coated with polyethylene glycol (PEG), and protamine-nucleic acid complexes coated with lipid.

Exemplary lipids for gene transfer are shown below in Table 21.

Exemplary polymers for gene transfer are shown below in Table 22.

TABLE 22

Polymers Used for Gene Transfer

| Polymer | Abbreviation |
| --- | --- |
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine) biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amido ethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(a-[4-aminobutyl]-L-glycolic acid) | PAGA |
| Poly(D,L-lactic-co-glycolic acid) | PLGA |
| Poly(N-ethyl-4-vinylpyridinium bromide) | |

TABLE 21

Lipids Used for Gene Transfer

| Lipid | Abbreviation | Feature |
| --- | --- | --- |
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecy lammonium bromide | DDAB | Cationic |
| Dioctadecy lamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethyl-ammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-NO-tetradecyl-3-tetradecylaminopropionamidine | diC14-amidine | Cationic |
| Octadecenolyoxy [ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylmeethyl-acetamide | RPR209120 | Cationic |
| 1,2-dilinoleyloxy-3- dimethylaminopropane | DLinDMA | Cationic |
| 2,2-dilinoley1-4-dimethylaminoethyl-[1,3]- dioxolane | DLin-KC2-DMA | Cationic |
| dilinoleyl- methyl-4-dimethylaminobutyrate | DLin-MC3-DMA | Cationic |

TABLE 22-continued

Polymers Used for Gene Transfer

| Polymer | Abbreviation |
|---|---|
| Poly(phosphazene)s | PPZ |
| Poly(phosphoester)s | PPE |
| Poly (phosphoramidate)s | PPA |
| Poly(N-2-hydroxypropylmethacrylamide) | pHPMA |
| Poly(2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In an embodiment, the vehicle has targeting modifications to increase target cell update of nanoparticles and liposomes, e.g., cell specific antigens, monoclonal antibodies, single chain antibodies, aptamers, polymers, sugars, and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimulus-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle. In an embodiment, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacterium longum*, and modified *Escherichia coli*), bacteria having nutritional and tissue-specific tropism to target specific cells, bacteria having modified surface proteins to alter target cell specificity). In an embodiment, the vehicle is a genetically modified bacteriophage (e.g., engineered phages having large packaging capacity, less immunogenicity, containing mammalian plasmid maintenance sequences and having incorporated targeting ligands). In an embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In an embodiment, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject-derived membrane-bound nanovescicles (30-100 nm) of endocytic origin (e.g., can be produced from various cell types and can therefore be taken up by cells without the need for targeting ligands).

In an embodiment, one or more nucleic acid molecules (e.g., DNA molecules) other than the components of a Cas system, e.g., the Cas9 molecule component and/or the gRNA molecule component described herein, are delivered. In an embodiment, the nucleic acid molecule is delivered at the same time as one or more of the components of the Cas system. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In an embodiment, the nucleic acid molecule is delivered by a different means from one or more of the components of the Cas system, e.g., the Cas9 molecule component and/or the gRNA molecule component. The nucleic acid molecule can be delivered by any of the delivery methods described herein. For example, the nucleic acid molecule can be delivered by a viral vector, e.g., a retrovirus or a lentivirus, and the Cas9 molecule component and/or the gRNA molecule component can be delivered by electroporation. In an embodiment, the nucleic acid molecule encodes a TRAC gene, a TRBC gene or a CAR gene.

(b) Delivery of RNA Encoding a Cas9 Molecule

RNA encoding Cas9 molecules (e.g., eaCas9 molecules, eiCas9 molecules or eiCas9 fusion proteins) and/or gRNA molecules, can be delivered into cells, e.g., target cells described herein, by art-known methods or as described herein. For example, Cas9-encoding and/or gRNA-encoding RNA can be delivered, e.g., by microinjection, electroporation, transient cell compression or squeezing (eg, as described in Lee, et al [2012] *Nano Lett* 12: 6322-27), lipid-mediated transfection, peptide-mediated delivery, or a combination thereof.

In an embodiment, delivery via electroporation comprises mixing the cells with the RNA encoding Cas9 molecules (e.g., eaCas9 molecules, eiCas9 molecules or eiCas9 fusion proteins) and/or gRNA molecules in a cartridge, chamber or cuvette and applying one or more electrical impulses of defined duration and amplitude. In an embodiment, delivery via electroporation is performed using a system in which cells are mixed with the RNA encoding Cas9 molecules (e.g., eaCas9 molecules, eiCas9 molecules or eiCas9 fusion proteins) and/or gRNA molecules in a vessel connected to a device (eg, a pump) which feeds the mixture into a cartridge, chamber or cuvette wherein one or more electrical impulses of defined duration and amplitude are applied, after which the cells are delivered to a second vessel.

(c) Delivery of Cas9 Protein and Ribonucleoprotein (RNP)

In some embodiments, the one or more agent(s) capable of introducing a cleavage, e.g., a Cas9/gRNA system, is introduced into the cell as a ribonucleoprotein (RNP) complex. RNP complexes include a sequence of ribonucleotides, such as an RNA or a gRNA molecule, and a protein, such as a Cas9 protein or variant thereof. For example, the Cas9 protein is delivered as RNP complex that comprises a Cas9 protein and a gRNA molecule targeting the target sequence, e.g., using electroporation or other physical delivery method. In some embodiments, the RNP is delivered into the cell via electroporation or other physical means, e.g., particle gun, calcium phosphate transfection, cell compression or squeezing. In some embodiments, the RNP can cross the plasma membrane of a cell without the need for additional delivery agents (e.g., small molecule agents, lipids, etc.).

In some embodiments, delivery of the one or more agent(s) capable of inducing genetic disruption, e.g., CRISPR/Cas9, as an RNP offers an advantage that the targeted disruption occurs transiently, e.g., in cells to which the RNP is introduced, without propagation of the agent to cell progenies. For example, delivery by RNP minimizes the agent from being inherited to its progenies, thereby reducing the chance of off-target genetic disruption in the progenies.

In some embodiments, more than one agent(s) or components thereof are delivered to the cell. For example, in some embodiments, agent(s) capable of inducing a genetic disruption of two or more locations in the genome, e.g., the TRAC, TRBC1 and/or TRBC2 loci, are delivered to the cell. In some embodiments, agent(s) and components thereof are delivered using one method. For example, in some embodiments, agent(s) for inducing a genetic disruption of TRAC, TRBC1 and/or TRBC2 loci are delivered as polynucleotides encoding the components for genetic disruption. In some embodiments, one polynucleotide can encode agents that target the TRAC, TRBC1 and/or TRBC2 loci. In some embodiments, two or more different polynucleotides can encode the agents that target TRAC, TRBC1 and/or TRBC2 loci. In some embodiments, the agents capable of inducing a genetic disruption can be delivered as ribonucleoprotein (RNP) complexes, and two or more different RNP complexes can be delivered together as a mixture, or separately.

Cas9 molecules (e.g., eaCas9 molecules, eiCas9 molecules or eiCas9 fusion proteins) can be delivered into cells by art-known methods or as described herein. For example, Cas9 protein molecules can be delivered, e.g., by microinjection, electroporation, transient cell compression or squeezing (eg, as described in Lee, et al [2012] *Nano Lett* 12: 6322-27), lipid-mediated transfection, peptide-mediated delivery, or a combination thereof. Delivery can be accompanied by DNA encoding a gRNA or by a gRNA. In some embodiments, the Cas9 protein is delivered as a ribonucleoprotein (RNP) complex that comprises a Cas9 protein provided herein and a gRNA molecule provided herein, e.g., a gRNA targeted for TRAC, TRBC1 and/or TRBC2. In some embodiments, a RNP complex includes a sequence of ribonucleotides, such as an RNA or a gRNA molecule, and a protein, such as a Cas9 protein or variant thereof. In some embodiments, the RNP that includes one or more gRNA molecules targeted for TRAC, TRBC1 and/or TRBC2 such as any as described and a Cas9 enzyme or variant thereof, is directly introduced into the cell via physical delivery (e.g., electroporation, particle gun, Calcium Phosphate transfection, cell compression or squeezing), liposomes or nanoparticles. In particular embodiments, the RNP includes one or more gRNA molecules targeted for TRAC, TRBC1 and/or TRBC2, such as any as described, and a Cas9 enzyme or variant thereof is introduced via electroporation.

In an embodiment, delivery via electroporation comprises mixing the cells with the Cas9 molecules (e.g., eaCas9 molecules, eiCas9 molecules or eiCas9 fusion proteins) with or without gRNA molecules in a cartridge, chamber or cuvette and applying one or more electrical impulses of defined duration and amplitude. In an embodiment, delivery via electroporation is performed using a system in which cells are mixed with the Cas9 molecules (e.g., eaCas9 molecules, eiCas9 molecules or eiCas9 fusion proteins) with or without gRNA molecules in a vessel connected to a device (e.g., a pump) which feeds the mixture into a cartridge, chamber or cuvette wherein one or more electrical impulses of defined duration and amplitude are applied, after which the cells are delivered to a second vessel.

B. Targeted Integration Via Homology Directed Repair (HDR)

In some of the embodiments provided herein, homology-directed repair (HDR) can be utilized for targeted integration of a specific portion of the template polynucleotide containing a transgene, e.g., nucleic acid sequence encoding any of the provided recombinant receptors, e.g., recombinant T cell receptor (TCR), at a particular location in the genome, e.g., the TRAC, TRBC1 and/or TRBC2 locus. In some embodiments, a template polynucleotide comprising a nucleic acid sequence, e.g., a transgene, encoding a recombinant T cell receptor (TCR) or antigen-binding fragment or chain thereof is introduced into a cell, e.g., an immune cell, having a genetic disruption of a target site within a T cell receptor alpha constant (TRAC) gene and/or a T cell receptor beta constant (TRBC) gene. In some embodiments, the nucleic acid sequence or transgene encoding the recombinant TCR or antigen-binding fragment or chain thereof is targeted for integration at or near the target site via homology directed repair (HDR). In particular embodiments, the integration at or near the target site is within a portion of coding sequence of a TRAC and/or TRBC gene, such as, for example, a portion of the coding sequence downstream of, or 3' of the target site.

In some embodiments, the target site is in a T cell receptor alpha constant (TRAC) gene. In some embodiments, the target site(s) is in a T cell receptor beta constant 1 (TRBC1) or T cell receptor beta constant 2 (TRBC2) gene. In some embodiments, one or more target sites are in a TRAC gene and one or both of a TRBC1 and a TRBC2 gene. In some embodiments, a template polynucleotide containing a nucleic acid sequence and/or a transgene encoding a recombinant receptor, such as any of the provided TCRs or a portion thereof, is introduced into an immune cell having a genetic disruption of one or more target site(s) within a TRAC, a TRBC1, and/or a TRBC2 gene is targeted at or near one of the at least one target site(s) via HDR.

In some embodiments, the targeted genetic disruption and targeted integration of the recombinant receptor-encoding nucleic acids by HDR occurs at one or more target site(s) (also known as "target position," "target DNA sequence" or "target location") the endogenous genes that encode one or more domains, regions and/or chains of the endogenous T cell receptor (TCR). In certain embodiments, the embodiments provided herein involve one or more targeted genetic disruption(s), e.g., DNA break, at one or more of the endogenous TCR gene loci (such as the endogenous genes encoding the TCRα and/or the TCRβ constant domains) by gene editing techniques, combined with targeted knock-in of nucleic acids encoding the recombinant receptor (such as a recombinant TCR or a CAR) by homology-directed repair (HDR). In some embodiments, the DNA break occurs as a result of a step in gene editing, for example, DNA breaks generated by targeted nucleases used to introduce a targeted genetic disruption, such as any described herein. Exemplary methods for gene editing endogenous TCR loci are known, and include but are not limited to those described herein or elsewhere, e.g., U.S. Publication Nos. US2011/0158957, US2014/0301990, US2015/0098954, US2016/0208243, US2016/272999 and US2015/056705; International PCT Publication Nos. WO2014/191128, WO2015/136001, WO2015/161276, WO2016/069283, WO2016/016341, WO2017/193107, and WO2017/093969; and Osborn et al. (2016) Mol. Ther. 24(3):570-581.

Alteration of nucleic acid sequences at the target site can occur by HDR with an exogenously provided template polynucleotide (also referred to as donor polynucleotide or template sequence). For example, the template polynucleotide provides for alteration of the target sequence, such as insertion of the transgene contained within the template polynucleotide. In some embodiments, a plasmid or a vector can be used as a template for homologous recombination. In some embodiments, a linear DNA fragment can be used as a template for homologous recombination. In some embodiments, a single stranded template polynucleotide can be used as a template for alteration of the target sequence by alternate methods of homology directed repair (e.g., single strand annealing) between the target sequence and the template polynucleotide. Template polynucleotide-effected alteration of a target sequence depends on cleavage by a nuclease, e.g., a targeted nuclease such as CRISPR/Cas9. Cleavage by the nuclease can comprise a double strand break or two single strand breaks.

In some embodiments, methods for HDR involve introducing into an immune cell, e.g. a T cell, one or more agent wherein each of the one or more agent is independently capable of inducing a genetic disruption of a T cell receptor alpha constant (TRAC) gene and/or a T cell receptor beta constant (TRBC) gene. In some embodiments, the one or more agents can include a zinc finger nuclease (ZFN), a TAL-effector nuclease (TALEN), or and a CRISPR-Cas9 combination that specifically binds to, recognizes, or hybridizes to the target site in the TRAC or TRBC locus, such as using methods described above in Section V.A. In some embodiments, the one or more agents are introduced using a CRISPR-Cas9 combination, in which each of the one or more agent comprises a guide RNA (gRNA) having a targeting domain that is complementary to the at least one target site. Any gRNA targeting domain sequences that targets the TRAC or TRBC locus can be used for carrying out genetic disruption, including any described above. In some embodiments, the TRAC locus for targeting the TRAC locus is GAGAAUCAAAAUCGGUGAAU (SEQ ID NO:1048). In some embodiments, the gRNA targeting domain sequence for targeting the TRBC locus is GGCCUCGGCGCUGACGAUCU (SEQ ID NO:1053).

In some embodiments, the HDR involves introducing into an immune cell, e.g. a T cell, one or more gRNA targeting sequences capable of inducing a genetic disruption of a T cell receptor alpha constant (TRAC) gene.

In some embodiments, the genetic disruption is carried out by introducing into the cell the gRNA targeting domain sequence together with a Cas9, such as using methods described above. The Cas9 can be introduced as a nucleic acid or as an encoded protein. In some embodiments, the genetic disruption is carried out by introducing into the cell, such as via electroporation, a ribonucleoprotein (RNP) complex comprising the gRNA and a Cas9 protein, such as using methods described above.

In some embodiments, HDR methods further include introducing into the cell a polynucleotide, such as a template polynucleotide, that contains (a) a nucleic acid sequence encoding any of the provided TCR or antigen-binding portions thereof and (b) one or more homology arms linked to the nucleic acid sequence, wherein the one or more homology arms comprise a sequence homologous to one or more region(s) of an open reading frame of a T cell receptor alpha constant (TRAC) locus. In some embodiments, the one or more homology arms facilitate transfer of genetic information from the template polynucleotide to the target locus, e.g. a target site of the TRAC locus.

In some embodiments, "recombination" refers to a process of exchange of genetic information between two polynucleotides. In some embodiments, "homologous recombination (HR)" refers to the specialized form of such exchange that takes place, for example, during repair of double-strand breaks in cells via homology-directed repair mechanisms. This process requires nucleotide sequence homology, uses a template polynucleotide to template repair of a target DNA (i.e., the one that experienced the double-strand break, e.g., target site in the endogenous gene), and is variously known as "non-crossover gene conversion" or "short tract gene conversion," because it leads to the transfer of genetic information from the template polynucleotide to the target. In some embodiments, such transfer can involve mismatch correction of heteroduplex DNA that forms between the broken target, e.g. due to genetic disruption, and the template polynucleotide, and/or "synthesis-dependent strand annealing," in which the template polynucleotide is used to resynthesize genetic information that will become part of the target, and/or related processes. Such specialized HR often results in an alteration of the sequence of the target molecule such that part or all of the sequence of the template polynucleotide is incorporated into the target polynucleotide.

In some embodiments, a template polynucleotide, e.g., polynucleotide containing transgene, is integrated into the genome of a cell via homology-independent mechanisms. The methods comprise creating a double-stranded break (DSB) in the genome of a cell and cleaving the template polynucleotide molecule using a nuclease, such that the template polynucleotide is integrated at the site of the DSB. In some embodiments, the template polynucleotide is integrated via non-homology dependent methods (e.g., NHEJ). Upon in vivo cleavage the template polynucleotides can be integrated in a targeted manner into the genome of a cell at the location of a DSB. The template polynucleotide can include one or more of the same target sites for one or more of the nucleases used to create the DSB. Thus, the template polynucleotide may be cleaved by one or more of the same nucleases used to cleave the endogenous gene into which integration is desired. In some embodiments, the template polynucleotide includes different nuclease target sites from the nucleases used to induce the DSB. As described herein, the genetic disruption of the target site or target position can be created by any mechanisms, such as ZFNs, TALENs, CRISPR/Cas9 system, or TtAgo nucleases.

In some of the embodiments provided herein, homology-directed repair (HDR) can be utilized for targeted integration of a specific portion of the template polynucleotide containing a transgene, e.g., nucleic acid sequence encoding any of the provided recombinant receptors, e.g., recombinant TCRs, at a particular location in the genome, e.g., the TRAC, TRBC1 and/or TRBC2 locus. In some embodiments, the presence of a genetic disruption (e.g., a DNA break) and a polynucleotide, e.g., a template polynucleotide containing one or more homology arms (e.g., nucleic acid sequences homologous to sequences surrounding the genetic disruption) are used to induce or direct HDR, with homologous sequences acting as a template for DNA repair.

In some embodiments, a template polynucleotide having homology with sequences at or near one or more target site(s) in the endogenous DNA can be used to alter the structure of a target DNA, e.g., targeted insertion of the transgene. In some embodiments, the template polynucleotide contains homology sequences (e.g., homology arms) flanking the transgene, e.g., nucleic acid sequences encoding a recombinant receptor, for targeted insertion. In some embodiments, the homology sequences target the transgene at one or more of the TRAC, TRBC1 and/or TRBC2 loci. In some embodiments, the template polynucleotide includes additional sequences (coding or non-coding sequences) between the homology arms, such as a regulatory sequences, such as promoters and/or enhancers, splice donor and/or acceptor sites, internal ribosome entry site (IRES), sequences encoding ribosome skipping elements (e.g., 2A peptides), markers and/or SA sites, and/or one or more additional transgenes.

In certain embodiments, the template polynucleotide includes or contains a transgene, a portion of a transgene, and/or a nucleic acid encodes recombinant receptor such as a recombinant TCR or chain thereof that contains one or more variable domains and one or more constant domains. In certain embodiments, the recombinant TCR or chain thereof contains one or more constant domains that shares complete, e.g., at or about 100% identity, to all or a portion and/or fragment of an endogenous TCR constant domain. In some embodiments, the transgene encodes all or a portion of a constant domain, e.g., a portion or fragment of the constant domain that is completely or partially identical to an endogenous TCR constant domain. In some embodiments, the transgene contains nucleotides of a sequence having at or at least 70%, 75%, 80%, 85%, 90%, 95%, 97%, 98%, 99%, 99.5%, or 99.9% sequence identity to all or a portion of the nucleic acid sequence set forth in SEQ ID NOS: 348, 349 or 1047.

In some of embodiments, the transgene contains a sequence encoding a TCRα and/or TCRβ chain or a portion thereof that has been codon-optimized. In some embodiments, the transgene encodes a portion of a TCRα and/or TCRβ chain with less than 100% amino acid sequence identity to a corresponding portion of a native or endogenous TCRα and/or TCRβ chain. In some embodiments, the encoded TCRα and/or TCRβ chain contains an amino acid sequence with, with about, or with at least 70%, 75%, 80%, 85%, 90%, 95%, 98%, 99%, or greater than 99% identity but less than 100% identity to a corresponding native or endogenous TCRα and/or TCRβ chain. In particular embodiments, the transgene encodes a TCRα and/or TCRβ constant domain or portion thereof with less than 100% amino acid sequence identity to a corresponding native or endogenous TCRα and/or TCRβ constant domain. In some embodiments, the TCRα and/or TCRβ constant domain contains an amino acid sequence with, with about, or with at least 70%, 75%, 80%, 85%, 90%, 95%, 98%, 99%, or greater than 99% identity but less than 100% identity to a corresponding native or endogenous TCRα and/or TCRβ chain. In particular embodiments, the transgene encodes a TCRα and/or TCRβ chain and/or a TCRα and/or TCRβ chain constant domains containing one or more modifications to introduce one or more disulfide bonds. In some embodiments, the transgene encodes a TCRα and/or TCRβ chain and/or a TCRα and/or TCRβ with one or more modifications to remove or prevent a native disulfide bond, e.g., between the TCRα encoded by the transgene and the endogenous TCRβ chain, or between the TCR β encoded by the transgene and the endogenous TCR α chain. In some embodiments, one or more native cysteines that form and/or are capable of forming a native inter-chain disulfide bond are substituted to another residue, e.g., serine or alanine. In some embodiments, the TCRα and/or TCRβ chain and/or a TCRα and/or TCRβ chain constant domains are modified to replace one or more non-cysteine residues to a cysteine. In some embodiments, the one or more non-native cysteine residues are capable of forming non-native disulfide bonds, e.g., between the recombinant TCRα and TCRβ chain encoded by the transgene. In some embodiments, the cysteine is introduced at one or more of residue Thr48, Thr45, Tyr10, Thr45, and Ser15 with reference to numbering of a TCRα constant domain set forth in SEQ ID NO: 1352. In certain embodiments, cysteines can be introduced at residue Ser57, Ser77, Ser17, Asp59, of Glu15 of the TCR β chain with reference to numbering of TCRβ chain set forth in SEQ ID NO: 1353. Exemplary non-native disulfide bonds of a TCR are described in published International PCT No. WO2006/000830, WO 2006/037960 and Kuball et al. (2007) Blood, 109:2331-2338.

In certain embodiments, the transgene contains one or more modifications(s) to introduce one or more cysteine residues that are capable of forming one or more non-native disulfide bridges between the TCRα chain and TCRβ chain. In some embodiments, the transgene encodes a TCRα chain or a portion or fragment thereof containing a TCRα constant domain containing a cysteine at a position corresponding to position 48 with numbering as set forth in SEQ ID NO: 1355. In some embodiments, the TCRα constant domain has an amino acid sequence set forth in any of SEQ ID NOS: 1352 or 1355, or a sequence of amino acids that has, has about, or has at least 70%, 75%, 80%, 85%, 90%, 95%, 97%, 98%, 99% sequence identity thereto containing one or more cysteine residues capable of forming a non-native disulfide bond with a TCRβ chain. In some embodiments, the transgene encodes a TCRβ chain or a portion thereof containing a TCRβ constant domain containing a cysteine at a position corresponding to position 57 with numbering as set forth in SEQ ID NO: 1353. In some embodiments, the TCRβ constant domain has an amino acid sequence set forth in any of SEQ ID NOS: 1353, 1354, or 1356, or a sequence of amino acids that has, has about, or has at least 70%, 75%, 80%, 85%, 90%, 95%, 97%, 98%, 99% sequence identity thereto containing one or more cysteine residues capable of forming a non-native disulfide bond with a TCRα chain.

The template polynucleotide can be DNA, single-stranded and/or double-stranded and can be introduced into a cell in linear or circular form. See also, U.S. Patent Publication Nos. 20100047805 and 20110207221. The template polynucleotide can also be introduced in DNA form, which may be introduced into the cell in circular or linear form. If introduced in linear form, the ends of the template polynucleotide can be protected (e.g., from exonucleolytic degradation) by known methods. For example, one or more dideoxynucleotide residues are added to the 3' terminus of a linear molecule and/or self-complementary oligonucleotides are ligated to one or both ends. See, for example, Chang et al. (1987) Proc. Natl. Acad. Sci. USA 84:4959-4963; Nehls et al. (1996) Science 272:886-889. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues. If introduced in double-stranded form, the template polynucleotide may include one or more nuclease target site(s), for example, nuclease target sites flanking the transgene to be integrated into the cell's genome. See, e.g., U.S. Patent Publication No. 20130326645.

In some embodiments, the template polynucleotide contains the transgene, e.g., recombinant receptor-encoding nucleic acid sequences, flanked by homology sequences (also called "homology arms") on the 5' and 3' ends, to allow the DNA repair machinery, e.g., homologous recombination machinery, to use the template polynucleotide as a template for repair, effectively inserting the transgene into the target site of integration in the genome. The homology arm should extend at least as far as the region in which end resection may occur, e.g., in order to allow the resected single stranded overhang to find a complementary region within the template polynucleotide. In some embodiments, a homology arm does not extend into repeated elements, e.g., ALU repeats or LINE repeats. Based on homology between the endogenous gene sequence surrounding the genetic disruption and the 5' and/or 3' homology arms included in the polynucleotide, e.g., template polynucleotide, cellular DNA repair machinery can use the template polynucleotide to repair the DNA break and resynthesize genetic information at the site of the genetic disruption, thereby effectively inserting or integrating the transgene sequences in the template polynucleotide at or near the site of the genetic disruption.

In some embodiments, a template polynucleotide comprises the following components: [5' homology arm]-[transgene]-[3' homology arm]. The homology arms provide for recombination into the chromosome, thus insertion of the transgene into the DNA at or near the cleavage site, e.g., target site(s). In some embodiments, the homology arms flank the most distal target site(s).

In some aspects, the transgene (e.g., exogenous nucleic acid sequences) within the template polynucleotide can be used to guide the location of target sites and/or homology arms. In some aspects, the target site of genetic disruption can be used as a guide to design template polynucleotides and/or homology arms used for HDR. In some embodiments, the genetic disruption can be targeted near a desired site of targeted integration of transgene sequences (e.g., encoding a recombinant TCR or a portion thereof). In some aspects, the target site is within an exon of the open reading frame of the TRAC, TRBC1 and/or TRBC2 locus. In some aspects, the target site is within an intron of the open reading frame of the TRAC, TRBC1 and/or TRBC2 locus.

Exemplary homology arm lengths include at least or at least about or is or is about 50, 100, 200, 250, 300, 400, 500, 600, 700, 750, 800, 900, 1000, 2000, 3000, 4000, or 5000 nucleotides. Exemplary homology arm lengths include less than or less than about or is or is about 50, 100, 200, 250, 300, 400, 500, 600, 700, 750, 800, 900, 1000, 2000, 3000, 4000, or 5000 nucleotides. In some embodiments, the homology arm length is 50-100, 100-250, 250-500, 500-750, 750-1000, 1000-2000, 2000-3000, 3000-4000, or 4000-5000 nucleotides. In certain embodiments, the template polynucleotide comprises at least or less than or about 200, 300, 400, 500, 600, 700, 800, 900 or 1000 base pairs of homology 5' of the target site, 3' of the target site, or both 5' and 3' of the target site, e.g., within the TRAC, TRBC1, and/or TRBC2 gene, locus, or open reading frame. In particular embodiments, the template polynucleotide contains nucleotide sequences, e.g., homology arms, having homology 5' of the target site, 3' of the target site, or both 5' and 3' of the target site, e.g., within the TRAC gene, locus, or open reading frame. In some embodiments, exemplary 5' and 3' homology arms for targeted integration at the TRAC locus are set forth in SEQ ID NOS: 1343 and 1344, respectively.

In some embodiments, the template polynucleotide can be linear single stranded DNA. In some embodiments, the template polynucleotide is (i) linear single stranded DNA that can anneal to the nicked strand of the target DNA, (ii) linear single stranded DNA that can anneal to the intact strand of the target DNA, (iii) linear single stranded DNA that can anneal to the transcribed strand of the target DNA, (iv) linear single stranded DNA that can anneal to the non-transcribed strand of the target DNA, or more than one of the preceding.

In some embodiments, the template polynucleotide contains homology arms for targeting the endogenous TRAC locus (exemplary nucleotide sequence of the human TRAC gene locus set forth in SEQ ID NO:348; NCBI Reference Sequence: NG_001332.3, TRAC or described in Table 13 herein). In some embodiments, the genetic disruption of the TRAC locus is introduced at early coding region the gene, including sequence immediately following a transcription start site, within a first exon of the coding sequence, or within 500 bp of the transcription start site (e.g., less than 500, 450, 400, 350, 300, 250, 200, 150, 100 or 50 bp), or within 500 bp of the start codon (e.g., less than 500, 450, 400, 350, 300, 250, 200, 150, 100 or 50 bp). In some embodiments, the genetic disruption is introduced using any of the targeted nucleases and/or gRNAs. In some embodiments, the template polynucleotide comprises about 500 to 1000, e.g., 600 to 900 or 700 to 800, base pairs of homology on either side of the genetic disruption introduced by the targeted nucleases and/or gRNAs. In some embodiments, the template polynucleotide comprises about 500, 600, 700, 800, 900 or 1000 base pairs of 5' homology arm sequences, which is homologous to 500, 600, 700, 800, 900 or 1000 base pairs of sequences 5' of the genetic disruption (e.g., at TRAC locus), the transgene, and about 500, 600, 700, 800, 900 or 1000 base pairs of 3' homology arm sequences, which is homologous to 500, 600, 700, 800, 900 or 1000 base pairs of sequences 3' of the genetic disruption (e.g., at TRAC locus). In some embodiments, exemplary 5' and 3' homology arms for targeted integration at the TRAC locus are set forth in SEQ ID NOS: 1343 and 1344.

In some embodiments, the template polynucleotide contains homology arms for targeting the endogenous TRBC1 or TRBC2 locus (exemplary nucleotide sequence of the human TRBC1 gene locus set forth in SEQ ID NO:349; NCBI Reference Sequence: NG_001333.2, TRBC1, described in Table 14 herein; exemplary nucleotide sequence of the human TRBC2 gene locus set forth in SEQ ID NO:1047; NCBI Reference Sequence: NG_001333.2, TRBC2, described in Table 15 herein). In some embodiments, the genetic disruption of the TRBC1 or TRBC2 locus is introduced at early coding region the gene, including sequence immediately following a transcription start site, within a first exon of the coding sequence, or within 500 bp of the transcription start site (e.g., less than 500, 450, 400, 350, 300, 250, 200, 150, 100 or 50 bp), or within 500 bp of the start codon (e.g., less than 500, 450, 400, 350, 300, 250, 200, 150, 100 or 50 bp). In some embodiments, the genetic disruption is introduced using any of the targeted nucleases and/or gRNAs described herein. In some embodiments, the template polynucleotide comprises about 500 to 1000, e.g., 600 to 900 or 700 to 800, base pairs of homology on either side of the genetic disruption introduced by the targeted nucleases and/or gRNAs. In some embodiments, the template polynucleotide comprises about 500, 600, 700, 800, 900 or 1000 base pairs of 5' homology arm sequences, which is homologous to 500, 600, 700, 800, 900 or 1000 base pairs of sequences 5' of the genetic disruption (e.g., at TRBC1 or TRBC2 locus), the transgene, and about 500, 600, 700, 800, 900 or 1000 base pairs of 3' homology arm sequences, which is homologous to 500, 600, 700, 800, 900 or 1000 base pairs of sequences 3' of the genetic disruption (e.g., at TRBC1 or TRBC2 locus).

In some instances, the template polynucleotide comprises a promoter, e.g., a promoter that is exogenous and/or not present at or near the target locus. In some embodiments, the promoter drives expression only in a specific cell type (e.g., a T cell or B cell or NK cell specific promoter). In some embodiments in which the functional polypeptide encoding sequences are promoterless, expression of the integrated transgene is then ensured by transcription driven by an endogenous promoter or other control element in the region of interest.

The transgene, including the transgene encoding the recombinant receptor or antigen-binding portion thereof or α chain thereof and/or more additional transgene, can be inserted so that its expression is driven by the endogenous promoter at the integration site, namely the promoter that drives expression of the endogenous TCR gene to which it is inserted (e.g., TRAC, TRBC1 and/or TRBC2). For example, in some embodiments, the coding sequences in the transgene can be inserted without a promoter, but in-frame with the coding sequence of the endogenous target gene, such that expression of the integrated transgene is controlled by the transcription of the endogenous promoter at the integration site. In some embodiments, the transgene encoding the recombinant TCR or antigen-binding fragment or chain thereof and/or the one or more second transgene independently is operably linked to the endogenous promoter of the gene at the target site. In some embodiments, a ribosome skipping element/self-cleavage element, such as a 2A element, is placed upstream of the transgene coding sequence, such that the ribosome skipping element/self-cleavage element is placed in-frame with the endogenous gene. In some embodiments, the transgene encoding the recombinant TCR or antigen-binding fragment thereof or portion thereof is operably linked to the endogenous promoter of the gene at the target site (e.g., TRAC, TRBC1 and/or TRBC2).

In some embodiments, the transgene may comprise a promoter and/or enhancer, for example a constitutive promoter or an inducible or tissue-specific promoter. In some embodiments, the promoter is or comprises a constitutive promoter. Exemplary constitutive promoters include, e.g., simian virus 40 early promoter (SV40), cytomegalovirus immediate-early promoter (CMV), human Ubiquitin C promoter (UBC), human elongation factor 1α promoter (EF1α), mouse phosphoglycerate kinase 1 promoter (PGK), and chicken β-Actin promoter coupled with CMV early enhancer (CAGG). In some embodiments, the constitutive promoter is a synthetic or modified promoter. In some embodiments, the promoter is or comprises an MND promoter, a synthetic promoter that contains the U3 region of a modified MoMuLV LTR with myeloproliferative sarcoma virus enhancer (sequence set forth in SEQ ID NO: 1361 or 1347); see Challita et al. (1995) J. Virol. 69(2):748-755). In some embodiments, the promoter is a tissue-specific promoter. In another embodiment, the promoter is a viral promoter. In another embodiment, the promoter is a non-viral promoter. In some cases, the promoter is selected from among human elongation factor 1 alpha (EF1α) promoter (sequence set forth in SEQ ID NO: 1359 or 1360) or a modified form thereof (EF1α promoter with HTLV1 enhancer; sequence set forth in SEQ ID NO: 1345) or the MND promoter (sequence set forth in SEQ ID NO: 1361 or 1347. In some embodiments, the transgene does not include a regulatory element, e.g. promoter.

The transgene may be inserted into an endogenous gene such that all, some or none of the endogenous gene is expressed. In some embodiments, the transgene (e.g., with or without peptide-encoding sequences) is integrated into any endogenous locus. In some embodiments, the transgene is integrated into the TRAC, TRBC1 and/or TRBC2 gene loci.

Additionally, splice acceptor sequences may be included. Exemplary known splice acceptor site sequences include, e.g., CTGACCTCTTCTCTTCCTCCCACAG, (SEQ ID NO: 1357) (from the human HBB gene) and TTTCTCTC-CACAG (SEQ ID NO: 1358) (from the human Immunoglobulin-gamma gene).

In an exemplary embodiment, the template polynucleotide includes homology arms for targeting at the TRAC locus, regulatory sequences, e.g., promoter, and nucleic acid sequences encoding a recombinant receptor, e.g., TCR. In an exemplary embodiment, an additional template polynucleotide is employed, that includes homology arms for targeting at TRBC1 and/or TRBC2 loci, regulatory sequences, e.g., promoter, and nucleic acid sequences encoding another factor.

In some embodiments, exemplary template polynucleotides contain transgene encoding a recombinant T cell receptor under the operable control of the human elongation factor 1 alpha (EF1α) promoter with HTLV1 enhancer (sequence set forth in SEQ ID NO: 1345) or the MND promoter (sequence set forth in SEQ ID NO: 1361 or 1347) or linked to nucleic acid sequences encoding a P2A ribosome skipping element (sequence set forth in SEQ ID NO:204) to drive expression of the recombinant TCR from the endogenous target gene locus (e.g., TRAC), 5' homology arm sequence of approximately 600 bp (e.g., set forth in SEQ ID NO: 1343), 3' homology arm sequence of approximately 600 bp (e.g., set forth in SEQ ID NO: 1344) that are homologous to sequences surrounding the target integration site in exon 1 of the human TCR α constant region (TRAC) gene. In some embodiments, the template polynucleotide further contains other nucleic acid sequences, e.g., nucleic acid sequences encoding a marker, e.g., a surface marker or a selection marker. In some embodiments, the template polynucleotide further contains viral vector sequences, e.g., adeno-associated virus (AAV) vector sequences.

In some embodiments, the transgene further encodes one or more marker(s). In some embodiments, the one or more marker(s) is a transduction marker, surrogate marker and/or a selection marker, including but not limited to any surrogate and/or selection marker described herein.

In some embodiments, the polynucleotide, e.g., the template polynucleotide, comprises a nucleic acid sequence encoding a fraction and/or a portion of a recombinant receptor or chain thereof, e.g., a recombinant TCR or α chain thereof and is targeted at a target site(s) that is within a gene locus that encodes an endogenous receptor, e.g., an endogenous gene encoding a TCR chain or domain. In certain embodiments, the nucleic acid sequence is targeted for in-frame integration within the endogenous gene locus. In particular embodiments, the in-frame integration results in a coding sequence for the recombinant receptor that contains the nucleic acid sequence encoding the portion and/or fragment of the recombinant receptor in frame with the portion and/or fragment of the gene locus that encodes the remaining portion and/or fragment of the receptor, such as to integrate exogenous and endogenous nucleic acid sequences to arrive at a coding sequence encoding a complete, whole, and/or full length recombinant receptor. In certain embodiments, the integration genetically disrupts expression of the endogenous receptor encoded by gene at the target site. In particular embodiments, the transgene encoding the portion of the recombinant receptor is targeted within the gene locus via HDR.

In some embodiments, the transgene encodes a portion of the recombinant TCR and is integrated in-frame into an endogenous open reading frame and/or gene locus encoding α chain or a domain of a TCR. In certain embodiments, the transgene encodes a portion of a recombinant TCR and is inserted in-frame within an endogenous open reading frame encoding a TCR constant domain. In some embodiments, the integration of the transgene into the locus modifies and/or results in a modified locus that encodes the full recombinant TCR. In particular embodiments, a portion of the encoded recombinant TCR is encoded by a nucleic acid sequence present in the transgene, and the remaining portion of the recombinant TCR is encoded by a nucleic acid sequence present in the open reading frame of the endogenous gene encoding TCRα or TCRβ constant domains (e.g., described in Tables 13-15 herein). In particular embodiments, the transcription of the modified locus results in an mRNA that encodes the recombinant TCR. In particular embodiments, a portion of the mRNA is transcribed from a nucleic acid sequence present in the transgene, and the remaining or further portion of the mRNA is transcribed from a nucleic acid sequence present in the open reading frame of the endogenous gene. In some embodiments, the transgene is integrated at a target site immediately upstream of and in frame with of the region or portion of the open reading frame that encodes the remaining portion of the recombinant TCR.

In particular embodiments, the modified TRAC or TRBC locus includes nucleic acid sequences encoding a recombinant TCR. In some aspects, the modified TRAC or TRBC locus in the genetically engineered cell comprises a transgene sequence (also referred to herein as exogenous or heterologous nucleic acid sequences) encoding a portion of a recombinant TCR, integrated into an endogenous TRAC or TRBC locus, which normally encodes a TCRα or TCRβ constant domain. In some embodiments, the methods involve inducing a targeted genetic disruption and homology-dependent repair (HDR), using template polynucleotides containing the transgene encoding a portion of the recombinant TCR, thereby targeting integration of the transgene at the TRAC or TRBC locus.

In some embodiments, the transgene sequence encoding a portion of the recombinant TCR contains a sequence of nucleotides encoding a TCRβ chain and a portion of a TCRα chain. In some embodiments, the portion of the TCRα chain encoded by the transgene sequences comprises less than a full length of the TCRα chain. In particular embodiments, the portion of the TCRα chain contains a TCRα variable domain and a portion of a TCRα constant domain that is less than a full length TCRα constant domain, e.g., a full length native TCRα constant domain, or does not contain a sequence encoding the TCRα constant domain. In some aspects, upon integration of the transgene sequence into the endogenous TRAC locus, the resulting modified TRAC locus encodes a recombinant TCR receptor, encoded by a fusion of the transgene, targeted by HDR, and an open reading frame or a partial sequence thereof of an endogenous TRAC locus. In some embodiments, the encoded recombinant TCR contains a TCRα chain, e.g., a functional TCRα chain that is capable of binding to a TCRβ chain.

In particular embodiments, the transgene sequence encoding a portion of the recombinant TCR contains a sequence of nucleotides encoding a TCRα chain and a portion of a TCRβ chain. In some embodiments, the portion of the TCRβ chain encoded by the transgene sequences is or includes less than a full length of the TCRβ chain. In particular embodiments, the portion of the TCRβ chain contains a TCRβ variable domain and a portion of a TCRβ constant domain that is less than a full length TCRβ constant domain, e.g., a full length native TCRβ constant domain, or does not contain a sequence encoding the TCRβ constant domain. In some aspects, upon integration of the transgene sequence into the endogenous TRBC locus, e.g., a TRBC1 and/or TRBC2 locus, the resulting modified TRBC locus encodes a recombinant TCR receptor, encoded by a fusion of the transgene, targeted by HDR, and an open reading frame or a partial sequence thereof of an endogenous TRBC locus. In some embodiments, the encoded recombinant TCR contains a TCRβ chain, e.g., a functional TCRβ chain that is capable of binding to a TCRα chain.

In particular embodiments, the recombinant receptor is a recombinant TCR or chain thereof that contains one or more variable domains and one or more constant domains. In particular embodiments, the transgene encodes the portion and/or fragment of the recombinant TCR that does not include a TCR constant domain, and the transgene is integrated in-frame with the sequence, e.g., genomic DNA sequence, encoding the endogenous TCR constant domain. In certain embodiments, the integration results in a coding sequence that encodes the complete, whole, and/or full length recombinant TCR or chain thereof. In some embodiments, the coding sequence contains the transgene sequence encoding the portion or fragment of the TCR or chain thereof and an endogenous sequence encoding the endogenous TCR constant domain.

In some embodiments the portion of the recombinant TCR comprises a full length TCRβ chain (including TCRβ variable domain and TCRβ constant domain), a TCRα variable domain, and a portion of a TCRα constant domain. In certain embodiments, the transgene is inserted or integrated into the TRAC locus, e.g. a TRAC open reading frame, at a target site, resulting in an in-frame insertion of the transgene with the region or portion of the open reading frame encoding the endogenous remaining portion of the TCRα constant domain. In certain embodiments, the insertion results in a modified TRAC locus encoding the full recombinant TCR. In some embodiments, the modified TRAC locus encodes a recombinant TCR, of which a portion is encoded by the nucleic acid sequence of the transgene, such as a portion that includes the full length TCRβ chain (including TCRβ variable domain and TCRβ constant domain), a TCRα variable domain, and a portion of a TCRα constant domain and the remaining or further portion, such as the remaining or further portion of the TCRα constant domain, is encoded by an endogenous and/or native TRAC sequence. In certain embodiments, the endogenous and/or native TRAC sequence encodes the remaining portion of the recombinant TCR. In some embodiments; the template polynucleotide further contains other nucleic acid sequences, e.g., nucleic acid sequences encoding a marker, e.g., a surface marker or a selection marker. In some embodiments, the template polynucleotide further contains viral vector sequences, e.g., adeno-associated virus (AAV) vector sequences.

In some embodiments, the polynucleotide, e.g., a polynucleotide such as a template polynucleotide encoding the recombinant T cell receptor, are introduced into the cells in nucleotide form, e.g., as a polynucleotide or a vector. In some embodiments, the template polynucleotide is introduced into the cell for engineering, in addition to the agent(s) capable of inducing a targeted genetic disruption, e.g., nuclease and/or gRNAs. In some embodiments, the template polynucleotide(s) may be delivered prior to, simultaneously or after the agent(s) capable of inducing a targeted genetic disruption is introduced into a cell. In some embodiments, the template polynucleotide(s) are delivered simultaneously with the agents. In some embodiments, the template polynucleotides are delivered prior to the agents, for example, seconds to hours to days before the template polynucleotides, including, but not limited to, 1 to 60 minutes (or any time there between) before the agents, 1 to 24 hours (or any time there between) before the agents or more than 24 hours before the agents. In some embodiments, the template polynucleotides are delivered after the agents, seconds to hours to days after the template polynucleotides, including immediately after delivery of the agent, e.g., between 1 minute to 4 hours, such as about 10 minutes, 20 minutes, 30 minutes, 40 minutes, 50 minutes, 60 minutes, 90 minutes, 2 hours, 3 hours or 4 hours after delivery of the agents and/or preferably within 4 hours of delivery of the agents. In some embodiments, the template polynucleotide is delivered more than 4 hours after delivery of the agents.

In some embodiments, the template polynucleotides may be delivered using the same delivery systems as the agent(s) capable of inducing a targeted genetic disruption, e.g., nuclease and/or gRNAs. In some embodiments, the template polynucleotides may be delivered using different same delivery systems as the agent(s) capable of inducing a targeted genetic disruption, e.g., nuclease and/or gRNAs. In some embodiments, the template polynucleotide is delivered simultaneously with the agent(s). In other embodiments, the template polynucleotide is delivered at a different time, before or after delivery of the agent(s). In certain embodiments, any suitable method known for introducing a polynucleotide into a cell may be used to deliver agents and/or template DNA, including those described herein.

In particular embodiments, the polynucleotide, e.g., the template polynucleotide, are introduced into the cells in nucleotide form, e.g., as or within a non-viral vector. In some embodiments, the non-viral vector is or includes a polynucleotide, e.g., a DNA or RNA polynucleotide, that is suitable for transduction and/or transfection by any suitable and/or known non-viral method for gene delivery, such as but not limited to microinjection, electroporation, transient cell compression or squeezing (e.g., as described in Lee, et al. (2012) *Nano Lett* 12: 6322-27), lipid-mediated transfection, peptide-mediated delivery, e.g., cell-penetrating peptides, or a combination thereof.

In some embodiments, the template polynucleotide sequence can be comprised in a vector molecule containing sequences that are not homologous to the region of interest in the genomic DNA. In some embodiments, the virus is a DNA virus (e.g., dsDNA or ssDNA virus). In some embodiments, the virus is an RNA virus (e.g., an ssRNA virus). Exemplary viral vectors/viruses include, e.g., retroviruses, lentiviruses, adenovirus, adeno-associated virus (AAV), vaccinia viruses, poxviruses, and herpes simplex viruses, or any of the viruses described elsewhere herein.

In some embodiments, the template polynucleotide can be transferred into cells using recombinant infectious virus particles, such as, e.g., vectors derived from simian virus 40 (SV40), adenoviruses, adeno-associated virus (AAV). In some embodiments, the template polynucleotide are transferred into T cells using recombinant lentiviral vectors or retroviral vectors, such as gamma-retroviral vectors (see, e.g., Koste et al. (2014) Gene Therapy 2014 Apr. 3. doi: 10.1038/gt.2014.25; Carlens et al. (2000) Exp Hematol 28(10): 1137-46; Alonso-Camino et al. (2013) Mol Ther Nucl Acids 2, e93; Park et al., Trends Biotechnol. 2011 Nov. 29(11): 550-557 or HIV-1 derived lentiviral vectors.

In some embodiments, the retroviral vector has a long terminal repeat sequence (LTR), e.g., a retroviral vector derived from the Moloney murine leukemia virus (MoMLV), myeloproliferative sarcoma virus (MPSV), murine embryonic stem cell virus (MESV), murine stem cell virus (MSCV), or spleen focus forming virus (SFFV). Most retroviral vectors are derived from murine retroviruses. In some embodiments, the retroviruses include those derived from any avian or mammalian cell source. The retroviruses typically are amphotropic, meaning that they are capable of infecting host cells of several species, including humans. In one embodiment, the gene to be expressed replaces the retroviral gag, pol and/or env sequences. A number of illustrative retroviral systems have been described (e.g., U.S. Pat. Nos. 5,219,740; 6,207,453; 5,219,740; Miller and Rosman (1989) BioTechniques 7:980-990; Miller, A. D. (1990) Human Gene Therapy 1:5-14; Scarpa et al. (1991) Virology 180:849-852; Burns et al. (1993) Proc. Natl. Acad. Sci. USA 90:8033-8037; and Boris-Lawrie and Temin (1993) Cur. Opin. Genet. Develop. 3:102-109).

In other aspects, the template polynucleotide is delivered by viral and/or non-viral gene transfer methods. In some embodiments, the template polynucleotide is delivered to the cell via an adeno associated virus (AAV). Any AAV vector can be used, including, but not limited to, AAV1, AAV2, AAV3, AAV4, AAV5, AAV6, AAV7, AAV8 and combinations thereof. In some instances, the AAV comprises LTRs that are of a heterologous serotype in comparison with the capsid serotype (e.g., AAV2 ITRs with AAV5, AAV6, or AAV8 capsids). The template polynucleotide may be delivered using the same gene transfer system as used to deliver the nuclease (including on the same vector) or may be delivered using a different delivery system that is used for the nuclease. In some embodiments, the template polynucleotide is delivered using a viral vector (e.g., AAV) and the nuclease(s) is(are) delivered in mRNA form. The cell may also be treated with one or more molecules that inhibit binding of the viral vector to a cell surface receptor as described herein prior to, simultaneously and/or after delivery of the viral vector (e.g., carrying the nuclease(s) and/or template polynucleotide).

In some embodiments, the one or more agent(s) and the template polynucleotide are delivered in the same format or method. For example, in some embodiments, the one or more agent(s) and the template polynucleotide are both comprised in a vector, e.g., viral vector. In some embodiments, the template polynucleotide is encoded on the same vector backbone, e.g. AAV genome, plasmid DNA, as the Cas9 and gRNA. In some aspects, the one or more agent(s) and the template polynucleotide are in different formats, e.g., ribonucleic acid-protein complex (RNP) for the Cas9-gRNA agent and a linear DNA for the template polynucleotide, but they are delivered using the same method. In some embodiments, the template polynucleotides and nucleases may be on the same vector, for example an AAV vector (e.g., AAV6). In some embodiments, the template polynucleotides are delivered using an AAV vector and the agent(s) capable of inducing a targeted genetic disruption, e.g., nuclease and/or gRNAs are delivered as a different form, e.g., as mRNAs encoding the nucleases and/or gRNAs. In some embodiments, the template polynucleotides and nucleases are delivered using the same type of method, e.g., a viral vector, but on separate vectors. In some embodiments, the template polynucleotides are delivered in a different delivery system as the agents capable of inducing a genetic disruption, e.g., nucleases and/or gRNAs. In some embodiments, the template polynucleotide is excised from a vector backbone in vivo, e.g., it is flanked by gRNA recognition sequences. In some embodiments, the template polynucleotide is on a separate polynucleotide molecule as the Cas9 and gRNA. In some embodiments, the Cas9 and the gRNA are introduced in the form of a ribonucleoprotein (RNP) complex, and the template polynucleotide is introduced as a polynucleotide molecule, e.g., in a vector or a linear nucleic acid molecule, e.g., linear DNA. Types or nucleic acids and vectors for delivery include any of those described herein.

VI. Compositions, Methods, and Uses

Also provided are compositions including the binding molecules, e.g. TCRs, and engineered cells, including pharmaceutical compositions and formulations, and methods of using and uses of the molecules and compositions, such as in the treatment of diseases, conditions, and disorders in which HPV16 E6 or E7 is expressed, and/or detection, diagnostic, and prognostic methods.

A. Pharmaceutical Compositions and Formulations

Provided are pharmaceutical formulations including the binding molecules, e.g., TCR or antigen binding fragment thereof or antibody or antigen-binding fragment thereof, and/or the engineered cells expressing the binding molecules. The pharmaceutical compositions and formulations generally include one or more optional pharmaceutically acceptable carrier or excipient. In some embodiments, the composition includes at least one additional therapeutic agent.

The term "pharmaceutical formulation" refers to a preparation which is in such form as to permit the biological activity of an active ingredient contained therein to be effective, and which contains no additional components which are unacceptably toxic to a subject to which the formulation would be administered.

A "pharmaceutically acceptable carrier" refers to an ingredient in a pharmaceutical formulation, other than an active ingredient, which is nontoxic to a subject. A pharmaceutically acceptable carrier includes, but is not limited to, a buffer, excipient, stabilizer, or preservative.

In some aspects, the choice of carrier is determined in part by the particular cell or binding molecule, and/or by the method of administration. Accordingly, there are a variety of suitable formulations. For example, the pharmaceutical composition can contain preservatives. Suitable preservatives may include, for example, methylparaben, propylparaben, sodium benzoate, and benzalkonium chloride. In some aspects, a mixture of two or more preservatives is used. The preservative or mixtures thereof are typically present in an amount of about 0.0001% to about 2% by weight of the total composition. Carriers are described, e.g., by Remington's Pharmaceutical Sciences 16th edition, Osol, A. Ed. (1980). Pharmaceutically acceptable carriers are generally nontoxic to recipients at the dosages and concentrations employed, and include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG).

Buffering agents in some aspects are included in the compositions. Suitable buffering agents include, for example, citric acid, sodium citrate, phosphoric acid, potassium phosphate, and various other acids and salts. In some aspects, a mixture of two or more buffering agents is used. The buffering agent or mixtures thereof are typically present in an amount of about 0.001% to about 4% by weight of the total composition. Methods for preparing administrable pharmaceutical compositions are known. Exemplary methods are described in more detail in, for example, Remington: The Science and Practice of Pharmacy, Lippincott Williams & Wilkins; 21st ed. (May 1, 2005).

Formulations of the binding molecules can include lyophilized formulations and aqueous solutions. The formulation or composition may also contain more than one active ingredient useful for the particular indication, disease, or condition being treated with the binding molecules or cells, preferably those with activities complementary to the binding molecule or cell, where the respective activities do not adversely affect one another. Such active ingredients are suitably present in combination in amounts that are effective for the purpose intended. Thus, in some embodiments, the pharmaceutical composition further includes other pharmaceutically active agents or drugs, such as chemotherapeutic agents, e.g., asparaginase, busulfan, carboplatin, cisplatin, daunorubicin, doxorubicin, fluorouracil, gemcitabine, hydroxyurea, methotrexate, paclitaxel, rituximab, vinblastine, vincristine, etc. In some embodiments, the cells or binding molecules are administered in the form of a salt, e.g., a pharmaceutically acceptable salt. Suitable pharmaceutically acceptable acid addition salts include those derived from mineral acids, such as hydrochloric, hydrobromic, phosphoric, metaphosphoric, nitric, and sulphuric acids, and organic acids, such as tartaric, acetic, citric, malic, lactic, fumaric, benzoic, glycolic, gluconic, succinic, and arylsulphonic acids, for example, p-toluenesulphonic acid.

Active ingredients may be entrapped in microcapsules, in colloidal drug delivery systems (for example, liposomes, albumin microspheres, microemulsions, nano-particles and nanocapsules) or in macroemulsions. In certain embodiments, the pharmaceutical composition is formulated as an inclusion complex, such as cyclodextrin inclusion complex, or as a liposome. Liposomes can serve to target the host cells (e.g., T-cells or NK cells) to a particular tissue. Many methods are available for preparing liposomes, such as those described in, for example, Szoka et al., Ann. Rev. Biophys. Bioeng., 9: 467 (1980), and U.S. Pat. Nos. 4,235,871, 4,501,728, 4,837,028, and 5,019,369.

The pharmaceutical composition in some aspects can employ time-released, delayed release, and sustained release delivery systems such that the delivery of the composition occurs prior to, and with sufficient time to cause, sensitization of the site to be treated. Many types of release delivery systems are available and known. Such systems can avoid repeated administrations of the composition, thereby increasing convenience to the subject and the physician.

The pharmaceutical composition in some embodiments contains the binding molecules and/or cells in amounts effective to treat or prevent the disease or condition, such as a therapeutically effective or prophylactically effective amount. Therapeutic or prophylactic efficacy in some embodiments is monitored by periodic assessment of treated subjects. For repeated administrations over several days or longer, depending on the condition, the treatment is repeated until a desired suppression of disease symptoms occurs. However, other dosage regimens may be useful and can be determined. The desired dosage can be delivered by a single bolus administration of the composition, by multiple bolus administrations of the composition, or by continuous infusion administration of the composition.

In certain embodiments, in the context of genetically engineered cells containing the binding molecules, a subject is administered the range of about one million to about 100 billion cells, such as, e.g., 1 million to about 50 billion cells (e.g., about 5 million cells, about 25 million cells, about 500 million cells, about 1 billion cells, about 5 billion cells, about 20 billion cells, about 30 billion cells, about 40 billion cells, or a range defined by any two of the foregoing values), such as about 10 million to about 100 billion cells (e.g., about 20 million cells, about 30 million cells, about 40 million cells, about 60 million cells, about 70 million cells, about 80 million cells, about 90 million cells, about 10 billion cells, about 25 billion cells, about 50 billion cells, about 75 billion cells, about 90 billion cells, or a range defined by any two of the foregoing values), and in some cases about 100 million cells to about 50 billion cells (e.g., about 120 million cells, about 250 million cells, about 350 million cells, about 450 million cells, about 650 million cells, about 800 million cells, about 900 million cells, about 3 billion cells, about 30 billion cells, about 45 billion cells) or any value in between these ranges, and/or such a number of cells per kilogram of body weight of the subject.

The cells or binding molecules may be administered using standard administration techniques, formulations, and/or devices. Provided are formulations and devices, such as syringes and vials, for storage and administration of the compositions. Administration of the cells can be autologous or heterologous. For example, immunoresponsive cells or progenitors can be obtained from one subject, and administered to the same subject or a different, compatible subject. Peripheral blood derived immunoresponsive cells or their progeny (e.g., in vivo, ex vivo or in vitro derived) can be administered via localized injection, including catheter administration, systemic injection, localized injection, intravenous injection, or parenteral administration. When administering a therapeutic composition (e.g., a pharmaceutical composition containing a genetically modified immunoresponsive cell), it will generally be formulated in a unit dosage injectable form (solution, suspension, emulsion).

Formulations include those for oral, intravenous, intraperitoneal, subcutaneous, pulmonary, transdermal, intramuscular, intranasal, buccal, sublingual, or suppository administration. In some embodiments, the cell populations are administered parenterally. The term "parenteral," as used herein, includes intravenous, intramuscular, subcutaneous, rectal, vaginal, intracranial, intrathoracic, and intraperitoneal administration. In some embodiments, the cell populations are administered to a subject using peripheral systemic delivery by intravenous, intraperitoneal, or subcutaneous injection.

Compositions in some embodiments are provided as sterile liquid preparations, e.g., isotonic aqueous solutions, suspensions, emulsions, dispersions, or viscous compositions, which may in some aspects be buffered to a selected pH. Liquid preparations are normally easier to prepare than gels, other viscous compositions, and solid compositions. Additionally, liquid compositions are somewhat more convenient to administer, especially by injection. Viscous compositions, on the other hand, can be formulated within the appropriate viscosity range to provide longer contact periods with specific tissues. Liquid or viscous compositions can comprise carriers, which can be a solvent or dispersing medium containing, for example, water, saline, phosphate buffered saline, polyol (for example, glycerol, propylene glycol, liquid polyethylene glycol) and suitable mixtures thereof.

Sterile injectable solutions can be prepared by incorporating the binding molecule in a solvent, such as in admixture with a suitable carrier, diluent, or excipient such as sterile water, physiological saline, glucose, dextrose, or the like. The compositions can also be lyophilized. The compositions can contain auxiliary substances such as wetting, dispersing, or emulsifying agents (e.g., methylcellulose), pH buffering agents, gelling or viscosity enhancing additives, preservatives, flavoring agents, colors, and the like, depending upon the route of administration and the preparation desired. Standard texts may in some aspects be consulted to prepare suitable preparations.

Various additives which enhance the stability and sterility of the compositions, including antimicrobial preservatives, antioxidants, chelating agents, and buffers, can be added. Prevention of the action of microorganisms can be ensured by various antibacterial and antifungal agents, for example, parabens, chlorobutanol, phenol, sorbic acid, and the like. Prolonged absorption of the injectable pharmaceutical form can be brought about by the use of agents delaying absorption, for example, aluminum monostearate and gelatin.

Sustained-release preparations may be prepared. Suitable examples of sustained-release preparations include semipermeable matrices of solid hydrophobic polymers containing the antibody, which matrices are in the form of shaped articles, e.g. films, or microcapsules.

The formulations to be used for in vivo administration are generally sterile. Sterility may be readily accomplished, e.g., by filtration through sterile filtration membranes.

B. Therapeutic and Prophylactic Methods and Uses

Also provided are methods of administering and uses, such as therapeutic and prophylactic uses, of the binding molecules, including TCRs and antigen-binding fragments thereof and antibodies or antigen-binding fragments thereof, and/or engineered cells expressing the binding molecules. Such methods and uses include therapeutic methods and uses, for example, involving administration of the molecules, cells, or compositions containing the same, to a subject having a disease, condition, or disorder expressing or associated with HPV, e.g., HPV16, and/or in which cells or tissues express, e.g., specifically express, HPV16, e.g., HPV16 E6 or E7. In some embodiments, the molecule, cell, and/or composition is administered in an effective amount to effect treatment of the disease or disorder. Uses include uses of the binding molecules and cells in such methods and treatments, and in the preparation of a medicament in order to carry out such therapeutic methods. In some embodiments, the methods are carried out by administering the binding molecules or cells, or compositions comprising the same, to the subject having, having had, or suspected of having the disease or condition. In some embodiments, the methods thereby treat the disease or condition or disorder in the subject.

As used herein, "treatment" (and grammatical variations thereof such as "treat" or "treating") refers to complete or partial amelioration or reduction of a disease or condition or disorder, or a symptom, adverse effect or outcome, or phenotype associated therewith. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. The terms do not imply complete curing of a disease or complete elimination of any symptom or effect(s) on all symptoms or outcomes.

As used herein, "delaying development of a disease" means to defer, hinder, slow, retard, stabilize, suppress and/or postpone development of the disease (such as cancer). This delay can be of varying lengths of time, depending on the history of the disease and/or individual being treated. As is evident to one skilled in the art, a sufficient or significant delay can, in effect, encompass prevention, in that the individual does not develop the disease. For example, a late stage cancer, such as development of metastasis, may be delayed.

"Preventing," as used herein, includes providing prophylaxis with respect to the occurrence or recurrence of a disease in a subject that may be predisposed to the disease but has not yet been diagnosed with the disease. In some embodiments, the provided molecules and compositions are used to delay development of a disease or to slow the progression of a disease.

As used herein, to "suppress" a function or activity is to reduce the function or activity when compared to otherwise same conditions except for a condition or parameter of interest, or alternatively, as compared to another condition. For example, a binding molecule or composition or cell which suppresses tumor growth reduces the rate of growth of the tumor compared to the rate of growth of the tumor in the absence of the binding molecule or composition or cell.

An "effective amount" of an agent, e.g., a pharmaceutical formulation, binding molecule, or cells, or composition, in the context of administration, refers to an amount effective, at dosages/amounts and for periods of time necessary, to achieve a desired result, such as a therapeutic or prophylactic result.

A "therapeutically effective amount" of an agent, e.g., a pharmaceutical formulation, binding molecule, or cells, refers to an amount effective, at dosages and for periods of time necessary, to achieve a desired therapeutic result, such as for treatment of a disease, condition, or disorder, and/or pharmacokinetic or pharmacodynamic effect of the treatment. The therapeutically effective amount may vary according to factors such as the disease state, age, sex, and weight of the subject, and the populations of cells administered. In some embodiments, the provided methods involve administering the binding molecules, cells, and/or compositions at effective amounts, e.g., therapeutically effective amounts.

A "prophylactically effective amount" refers to an amount effective, at dosages and for periods of time necessary, to achieve the desired prophylactic result. Typically but not necessarily, since a prophylactic dose is used in subjects prior to or at an earlier stage of disease, the prophylactically effective amount will be less than the therapeutically effective amount.

As used herein, a "subject" is a mammal, such as a human or other animal, and typically is human.

Among the diseases to be treated are cancers, typically HPV-associated cancers, and any HPV-associated, e.g., HPV 16-associated, diseases or conditions or diseases or conditions in which an HPV oncoprotein, e.g., E6 or E7, such as an HPV 16 oncoprotein, e.g., HPV 16 E6 or E7 is expressed. In certain diseases and conditions, the viral protein such as the oncoprotein such as the HPV 16 E6 or E7 is expressed in or by malignant cells and cancers, and/or a peptide epitope thereof is expressed on such malignant cancers or tissues, such as by way of MHC presentation. In some embodiments, the disease or condition is an HPV16-expressing cancer. In some embodiments, the cancer is a carcinoma, melanoma or other precancerous or cancerous state caused by or otherwise associated with HPV, such as HPV-16. In some embodiments, the carcinoma can be a squamous cell or adenocarionma. In some embodiments, the disease or condition can be characterized by an epithelial cell abnormality associated with oncogenic HPV infection, such as koilocytosis; hyperkeratosis; precancerous conditions encompassing intraepithelial neoplasias or intraepithelial lesion; high-grade dysplasias; and invasive or malignant cancers. Among the HPV 16-associated diseases or conditions that can be treated include, but are not limited to, cervical cancer, uterine cancer, anal cancer, colorectal cancer, vaginal cancer, vulvar cancer, penile cancer, oropharyngeal cancers, tonsil cancer, pharyngeal cancers (pharynx cancer), laryngeal cancer (larynx cancer), oral cancer, skin cancer, esophageal cancer, head and neck cancer such as a squamous cell carcinoma (SCC) head and neck cancer, or small cell lung cancer. In some embodiments, the disease or condition is a cervical carcinoma.

In some embodiments, the methods may include steps or features to identify a subject who has, is suspected to have, or is at risk for developing an HPV 16-associated disease or disorder (see e.g. U.S. Pat. Nos. 6,355,424 and 8,968,995) and/or the subject to be treated may be a subject identified to have or to be so at risk for having or developing such HPV-associated disease or condition or cancer. Hence, provided in some aspects are methods for identifying subjects with diseases or disorders associated with HPV 16 E6 or E7 expression and selecting them for treatment and/or treating such subjects, e.g., selectively treating such subjects, with a provided HPV 16 binding molecule, including in some aspects with cells engineered to express such binding molecules, including in some aspects any of the HPV 16 E6 or E7 TCRs or antigen binding fragments thereof or anti-HPV 16 E6 or E7 antibodies, e.g., antibody fragments and proteins containing the same, such as the chimeric receptors, e.g., TCR-like CARs, and/or engineered cells expressing the TCRs or CARs.

For example, a subject may be screened for the presence of a disease or disorder associated with HPV 16 E6 or E7 expression, such as an HPV 16 E6- or E7-expressing cancer. In some embodiments, the methods include screening for or detecting the presence of an HPV 16 E6- or E7-associated disease, e.g. a tumor. Thus, in some aspects, a sample may be obtained from a patient suspected of having a disease or disorder associated with HPV 16 E6 or E7 expression and assayed for the expression level of HPV 16 E6 or E7. In some aspects, a subject who tests positive for an HPV 16 E6- or E7-associated disease or disorder may be selected for treatment by the present methods, and may be administered a therapeutically effective amount of a binding molecule described herein, a CAR expressing such a binding molecule, cells containing the binding molecule, or a pharmaceutical composition thereof as described herein. In some embodiments, the methods can be used to monitor the size or density of an HPV 16 E6- or E7-expressing tissue, e.g. tumor, over time, e.g., before, during, or after treatment by the methods. In some aspects, subjects treated by methods provided herein have been selected or tested positive for HPV expression according to such methods, e.g., prior to initiation of or during treatment.

In some embodiments, administration of a provided HPV 16 binding molecule, including any of the HPV 16 E6 or E7 TCRs or antigen binding fragments thereof or anti-HPV 16 E6 or E7 antibodies, e.g., antibody fragments and proteins containing the same, such as the chimeric receptors, e.g., TCR-like CARs, and/or engineered cells expressing the TCRs or CARs, can be combined with another therapeutic for the treatment of an HPV disease. For example, the additional therapeutic treatment can include treatment with another anti-cancer agent for the treatment of cervical cancer. Suitable dosages for such a co-administered agent may be lowered due to the combined action (synergy) of the agent and the provide HPV 16 binding molecule.

In some embodiments, the subject has persistent or relapsed disease, e.g., following treatment with another HPV 16-specific binding molecule and/or cells expressing an HPV 16-targeting binding molecule and/or other therapy, including chemotherapy, radiation, and/or hematopoietic stem cell transplantation (HSCT), e.g., allogenic HSCT. In some embodiments, the administration effectively treats the subject despite the subject having become resistant to another HPV 16-targeted therapy. In some embodiments, the subject has not relapsed but is determined to be at risk for relapse, such as at a high risk of relapse, and thus the compound or composition is administered prophylactically, e.g., to reduce the likelihood of or prevent relapse.

In some embodiments, the treatment does not induce an immune response by the subject to the therapy, and/or does not induce such a response to a degree that prevents effective treatment of the disease or condition. In some aspects, the degree of immunogenicity and/or graft versus host response is less than that observed with a different but comparable treatment. For example, in the case of adoptive cell therapy using cells expressing TCRs or CARs including the provided binding molecules, the degree of immunogenicity in some embodiments is reduced compared to TCRs or CARs including a different binding molecule.

In some embodiments, the methods include adoptive cell therapy, whereby genetically engineered cells expressing the provided binding molecules are administered to subjects. Such administration can promote activation of the cells (e.g., T cell activation) in an HPV 16-targeted manner, such that the cells of the disease or disorder are targeted for destruction.

Thus, the provided methods and uses include methods and uses for adoptive cell therapy. In some embodiments, the methods include administration of the cells or a composition containing the cells to a subject, tissue, or cell, such as one having, at risk for, or suspected of having the disease, condition or disorder. In some embodiments, the cells, populations, and compositions are administered to a subject having the particular disease or condition to be treated, e.g., via adoptive cell therapy, such as adoptive T cell therapy. In some embodiments, the cells or compositions are administered to the subject, such as a subject having or at risk for the disease or condition. In some aspects, the methods thereby treat, e.g., ameliorate one or more symptom of the disease or condition, such as by lessening tumor burden in an HPV 16 E6- or E7-expressing cancer.

Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al; U.S. Pat. No. 4,690,915 to Rosenberg; Rosenberg (2011) Nat Rev Clin Oncol. 8(10):577-85). See, e.g., Themeli et al. (2013) Nat Biotechnol. 31(10): 928-933; Tsukahara et al. (2013) Biochem Biophys Res Commun 438(1): 84-9; Davila et al. (2013) PLoS ONE 8(4): e61338.

In some embodiments, the cell therapy, e.g., adoptive cell therapy, e.g., adoptive T cell therapy, is carried out by autologous transfer, in which the cells are isolated and/or otherwise prepared from the subject who is to receive the cell therapy, or from a sample derived from such a subject. Thus, in some aspects, the cells are derived from a subject, e.g., patient, in need of a treatment and the cells, following isolation and processing are administered to the same subject.

In some embodiments, the cell therapy, e.g., adoptive cell therapy, e.g., adoptive T cell therapy, is carried out by allogeneic transfer, in which the cells are isolated and/or otherwise prepared from a subject other than a subject who is to receive or who ultimately receives the cell therapy, e.g., a first subject. In such embodiments, the cells then are administered to a different subject, e.g., a second subject, of the same species. In some embodiments, the first and second subjects are genetically identical. In some embodiments, the first and second subjects are genetically similar. In some embodiments, the second subject expresses the same HLA class or supertype as the first subject.

In some embodiments, the subject, to whom the cells, cell populations, or compositions are administered, is a primate, such as a human. In some embodiments, the primate is a monkey or an ape. The subject can be male or female and can be any suitable age, including infant, juvenile, adolescent, adult, and geriatric subjects. In some embodiments, the subject is a non-primate mammal, such as a rodent. In some examples, the patient or subject is a validated animal model for disease, adoptive cell therapy, and/or for assessing toxic outcomes such as cytokine release syndrome (CRS).

The provided binding molecules, such as TCRs and antigen-binding fragments thereof and antibodies and antigen-binding fragments thereof, and cells expressing the same, can be administered by any suitable means, for example, by injection, e.g., intravenous or subcutaneous injections, intraocular injection, periocular injection, subretinal injection, intravitreal injection, trans-septal injection, subscleral injection, intrachoroidal injection, intracameral injection, subconjectval injection, subconjuntival injection, sub-Tenon's injection, retrobulbar injection, peribulbar injection, or posterior juxtascleral delivery. In some embodiments, they are administered by parenteral, intrapulmonary, and intranasal, and, if desired for local treatment, intralesional administration. Parenteral infusions include intramuscular, intravenous, intraarterial, intraperitoneal, intracranial, intrathoracic, or subcutaneous administration. Dosing and administration may depend in part on whether the administration is brief or chronic. Various dosing schedules include but are not limited to single or multiple administrations over various time-points, bolus administration, and pulse infusion.

For the prevention or treatment of disease, the appropriate dosage of the binding molecule or cell may depend on the type of disease to be treated, the type of binding molecule, the severity and course of the disease, whether the binding molecule is administered for preventive or therapeutic purposes, previous therapy, the patient's clinical history and response to the binding molecule, and the discretion of the attending physician. The compositions and molecules and cells are in some embodiments suitably administered to the patient at one time or over a series of treatments.

In certain embodiments, in the context of genetically engineered cells containing the binding molecules, a subject is administered the range of about one million to about 100 billion cells and/or that amount of cells per kilogram of body weight, such as, e.g., 1 million to about 50 billion cells (e.g., about 5 million cells, about 25 million cells, about 500 million cells, about 1 billion cells, about 5 billion cells, about 20 billion cells, about 30 billion cells, about 40 billion cells, or a range defined by any two of the foregoing values), such as about 10 million to about 100 billion cells (e.g., about 20 million cells, about 30 million cells, about 40 million cells, about 60 million cells, about 70 million cells, about 80 million cells, about 90 million cells, about 10 billion cells, about 25 billion cells, about 50 billion cells, about 75 billion cells, about 90 billion cells, or a range defined by any two of the foregoing values), and in some cases about 100 million cells to about 50 billion cells (e.g., about 120 million cells, about 250 million cells, about 350 million cells, about 450 million cells, about 650 million cells, about 800 million cells, about 900 million cells, about 3 billion cells, about 30 billion cells, about 45 billion cells) or any value in between these ranges and/or per kilogram of body weight. Again, dosages may vary depending on attributes particular to the disease or disorder and/or patient and/or other treatments.

In some embodiments, the binding molecules or cells are administered as part of a combination treatment, such as simultaneously with or sequentially with, in any order, another therapeutic intervention, such as another TCR, antibody or engineered cell or receptor or agent, such as a cytotoxic or therapeutic agent.

The cells or antibodies in some embodiments are co-administered with one or more additional therapeutic agents or in connection with another therapeutic intervention, either simultaneously or sequentially in any order. In some contexts, the cells are co-administered with another therapy sufficiently close in time such that the cell populations enhance the effect of one or more additional therapeutic agents, or vice versa. In some embodiments, the cells or antibodies are administered prior to the one or more additional therapeutic agents. In some embodiments, the cells or antibodies are administered after to the one or more additional therapeutic agents.

Once the cells are administered to a mammal (e.g., a human), the biological activity of the engineered cell populations and/or binding molecules in some aspects is measured by any of a number of known methods. Parameters to assess include specific binding of an engineered or natural T cell or other immune cell to antigen, in vivo, e.g., by imaging, or ex vivo, e.g., by ELISA or flow cytometry. In certain embodiments, the ability of the engineered cells to destroy target cells can be measured using any suitable method known in the art, such as cytotoxicity assays described in, for example, Kochenderfer et al., J. Immunotherapy, 32(7): 689-702 (2009), and Herman et al. J. Immunological Methods, 285(1): 25-40 (2004). In certain embodiments, the biological activity of the cells also can be measured by assaying expression and/or secretion of certain cytokines, such as CD 107a, IFNγ, IL-2, and TNF. In some aspects the biological activity is measured by assessing clinical outcome, such as reduction in tumor burden or load.

In certain embodiments, engineered cells are modified in any number of ways, such that their therapeutic or prophylactic efficacy is increased. For example, the engineered TCRs or antibody-expressing CARs expressed by the engineered cells in some embodiments are conjugated either directly or indirectly through a linker to a targeting moiety. The practice of conjugating compounds, e.g., the TCR or CAR, to targeting moieties is known in the art. See, for instance, Wadwa et al., J. Drug Targeting 3:111 (1995), and U.S. Pat. No. 5,087,616.

C. Diagnostic and Detection Methods

Also provided are methods involving use of the provided binding molecules, e.g., TCRs or antigen-binding fragments thereof and antibodies and antigen-binding fragments thereof, in detection of HPV 16, e.g., HPV 16 E6 or HPV 16 E7, for example, in diagnostic and/or prognostic methods in association with a HPV 16-expressing disease or condition. The methods in some embodiments include incubating a biological sample with the binding molecule and/or administering the binding molecule to a subject. In certain embodiments, a biological sample includes a cell or tissue, such as tumor or cancer tissue. In certain binding molecule to a region or peptide epitope of HPV 16, e.g., HPV 16 E6 or E7, and detecting whether a complex is formed between the binding molecule and peptide epitope. Such a method may be an in vitro or in vivo method. In one embodiment, an anti-HPV 16 binding molecule is used to select subjects eligible for therapy with an anti-HPV 16 binding molecules or engineered cells comprising such molecules, e.g. where HPV 16, e.g., HPV 16 E6 or E7 is a biomarker for selection of patients.

In some embodiments, a sample, such as a cell, tissue sample, lysate, composition, or other sample derived therefrom is contacted with the binding molecule and binding or formation of a complex between the binding molecule and the sample (e.g., region or epitope of HPV16 in the sample) is determined or detected. When binding in the test sample is demonstrated or detected as compared to a reference cell of the same tissue type, it may indicate the presence of an associated disease or condition. In some embodiments, the sample is from human tissues.

Various methods known in the art for detecting specific binding molecule-antigen binding can be used. Exemplary immunoassays include fluorescence polarization immunoassay (FPIA), fluorescence immunoassay (FIA), enzyme immunoassay (EIA), nephelometric inhibition immunoassay (NIA), enzyme linked immunosorbent assay (ELISA), and radioimmunoassay (RIA). An indicator moiety, or label group, can be attached to the subject binding molecules and may be selected so as to meet the needs of various uses of the method which are often dictated by the availability of assay equipment and compatible immunoassay procedures. Exemplary labels include radionuclides (e.g. $^{125}I$, $^{131}I$, $^{35}S$, $^{3}H$, or $^{32}P$), enzymes (e.g., alkaline phosphatase, horseradish peroxidase, luciferase, or β-glactosidase), fluorescent moieties or proteins (e.g., fluorescein, rhodamine, phycoerythrin, GFP, or BFP), or luminescent moieties (e.g., Qdot™ nanoparticles supplied by the Quantum Dot Corporation, Palo Alto, Calif.). General techniques to be used in performing the various immunoassays noted above are known to those of ordinary skill in the art.

For purposes of diagnosis, the binding molecules can be labeled with a detectable moiety including but not limited to radioisotopes, fluorescent labels, and various enzyme-substrate labels know in the art. Methods of conjugating labels to binding molecules, e.g., TCRs or antibodies, are known in the art. In some embodiments, the binding molecules need not be labeled, and the presence thereof can be detected using a labeled antibody which binds to the binding molecules.

The provided binding molecules in some embodiments can be employed in any known assay method, such as competitive binding assays, direct and indirect sandwich assays, and immunoprecipitation assays. The binding molecules can also be used for in vivo diagnostic assays, such as in vivo imaging. Generally, the binding molecule is labeled with a radionuclide (such as $^{111}In$, $^{99}Tc$, $^{14}C$, $^{131}I$, $^{125}I$, or $^{3}H$) so that the cells or tissue of interest can be localized in vivo following administration to a subject. The binding molecule may also be used as staining reagent in pathology, e.g., using known techniques.

VII. Articles of Manufacture

Also provided are articles of manufacture containing the provided binding molecules, e.g., TCRs, antibodies, and CARs and/or engineered cells, and/or compositions. The articles of manufacture may include a container and a label or package insert on or associated with the container. Suitable containers include, for example, bottles, vials, syringes, IV solution bags, etc. The containers may be formed from a variety of materials such as glass or plastic. The container in some embodiments holds a composition which is by itself or combined with another composition effective for treating, preventing and/or diagnosing the condition. In some embodiments, the container has a sterile access port. Exemplary containers include an intravenous solution bags, vials, including those with stoppers pierceable by a needle for injection. The label or package insert may indicate that the composition is used for treating the HPV 16 E6- or E7-expressing or -associated disease or condition. The article of manufacture may include (a) a first container with a composition contained therein, wherein the composition includes the antibody or engineered antigen receptor; and (b) a second container with a composition contained therein, wherein the composition includes a further agent, such as a cytotoxic or otherwise therapeutic agent. The article of manufacture may further include a package insert indicating that the compositions can be used to treat a particular condition. Alternatively, or additionally, the article of manufacture may further include another or the same container comprising a pharmaceutically-acceptable buffer. It may further include other materials such as other buffers, diluents, filters, needles, and/or syringes.

VIII. Definitions

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

The terms "polypeptide" and "protein" are used interchangeably to refer to a polymer of amino acid residues, and are not limited to a minimum length. Polypeptides, including the provided antibodies and antibody chains and other peptides, e.g., linkers, may include amino acid residues including natural and/or non-natural amino acid residues. The terms also include post-expression modifications of the polypeptide, for example, glycosylation, sialylation, acetylation, phosphorylation, and the like. In some aspects, the polypeptides may contain modifications with respect to a native or natural sequence, as long as the protein maintains the desired activity. These modifications may be deliberate, as through site-directed mutagenesis, or may be accidental, such as through mutations of hosts which produce the proteins or errors due to PCR amplification.

An "isolated" nucleic acid refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

"Isolated nucleic acid encoding a TCR or an antibody" refers to one or more nucleic acid molecules encoding TCR alpha or beta chains (or fragments thereof) or antibody heavy and light chains (or fragments thereof), including such nucleic acid molecule(s) in a single vector or separate vectors, and such nucleic acid molecule(s) present at one or more locations in a host cell.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

As used herein, "percent (%) amino acid sequence identity" and "percent identity" when used with respect to an amino acid sequence (reference polypeptide sequence) is defined as the percentage of amino acid residues in a candidate sequence (e.g., the subject antibody or fragment) that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared.

An amino acid substitution may include replacement of one amino acid in a polypeptide with another amino acid. Amino acid substitutions may be introduced into a binding molecule, e.g., TCR or antibody, of interest and the products screened for a desired activity, e.g., retained/improved antigen binding, decreased immunogenicity, or improved cytolytic activity.

Amino acids generally can be grouped according to the following common side-chain properties:
  (1) hydrophobic: Norleucine, Met, Ala, Val, Leu, Ile;
  (2) neutral hydrophilic: Cys, Ser, Thr, Asn, Gln;
  (3) acidic: Asp, Glu;
  (4) basic: His, Lys, Arg;
  (5) residues that influence chain orientation: Gly, Pro;
  (6) aromatic: Trp, Tyr, Phe.

In some embodiments, conservative substitutions can involve the exchange of a member of one of these classes for another member of the same class. In some embodiments, non-conservative amino acid substitutions can involve exchanging a member of one of these classes for another class.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors."

The term "package insert" is used to refer to instructions customarily included in commercial packages of therapeutic products, that contain information about the indications, usage, dosage, administration, combination therapy, contraindications and/or warnings concerning the use of such therapeutic products.

As used herein, the singular forms "a," "an," and "the" include plural referents unless the context clearly dictates otherwise. For example, "a" or "an" means "at least one" or "one or more." It is understood that aspects and variations described herein include "consisting" and/or "consisting essentially of" aspects and variations.

Throughout this disclosure, various aspects of the claimed subject matter are presented in a range format. It should be understood that the description in range format is merely for convenience and brevity and should not be construed as an inflexible limitation on the scope of the claimed subject matter. Accordingly, the description of a range should be considered to have specifically disclosed all the possible sub-ranges as well as individual numerical values within that range. For example, where a range of values is provided, it is understood that each intervening value, between the upper and lower limit of that range and any other stated or intervening value in that stated range is encompassed within the claimed subject matter. The upper and lower limits of these smaller ranges may independently be included in the smaller ranges, and are also encompassed within the claimed subject matter, subject to any specifically excluded limit in the stated range. Where the stated range includes one or both of the limits, ranges excluding either or both of those included limits are also included in the claimed subject matter. This applies regardless of the breadth of the range.

The term "about" as used herein refers to the usual error range for the respective value readily known to the skilled person in this technical field. Reference to "about" a value or parameter herein includes (and describes) embodiments that are directed to that value or parameter per se. For example, description referring to "about X" includes description of "X".

As used herein, a composition refers to any mixture of two or more products, substances, or compounds, including cells. It may be a solution, a suspension, liquid, powder, a paste, aqueous, non-aqueous or any combination thereof.

As used herein, a statement that a cell or population of cells is "positive" for a particular marker refers to the detectable presence on or in the cell of a particular marker, typically a surface marker. When referring to a surface marker, the term refers to the presence of surface expression as detected by flow cytometry, for example, by staining with an antibody that specifically binds to the marker and detecting said antibody, wherein the staining is detectable by flow cytometry at a level substantially above the staining detected carrying out the same procedure with an isotype-matched control under otherwise identical conditions and/or at a level substantially similar to that for cell known to be positive for the marker, and/or at a level substantially higher than that for a cell known to be negative for the marker.

As used herein, a statement that a cell or population of cells is "negative" for a particular marker refers to the absence of substantial detectable presence on or in the cell of a particular marker, typically a surface marker. When referring to a surface marker, the term refers to the absence of surface expression as detected by flow cytometry, for example, by staining with an antibody that specifically binds to the marker and detecting said antibody, wherein the staining is not detected by flow cytometry at a level substantially above the staining detected carrying out the same procedure with an isotype-matched control under otherwise identical conditions, and/or at a level substantially lower than that for cell known to be positive for the marker, and/or at a level substantially similar as compared to that for a cell known to be negative for the marker.

All publications, including patent documents, scientific articles and databases, referred to in this application are incorporated by reference in their entirety for all purposes to the same extent as if each individual publication were individually incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

IX. Exemplary Embodiments

Among the provided embodiments are:
1. A T cell receptor (TCR) or antigen-binding fragment thereof, comprising an alpha chain comprising a variable alpha (Vα) region and a beta chain comprising a variable beta (Vβ) region, wherein:
the Vα region comprises the amino acid sequence set forth in any of SEQ ID NOs: 691, 709, 726, 741, 759, 775, 787, 799, 815, 830, 845, 857, 869, 881, 895, 908, 925, 937, 951, 963, 975, 987, 999, or 1390, or an amino acid sequence that has at least 90%, 91%, 92%, 93%, 94%, 95%, 96%, 97%, 98%, or 99% sequence identity thereto; and/or
the Vβ region comprises the amino acid sequence set forth in any of SEQ ID NOs: 700, 718, 735, 750, 768, 781, 793, 808, 824, 839, 851, 863, 875, 887, 901, 917, 931, 945, 957, 969, 981, 993 1008, or 1380, or an amino acid sequence that has at least 90%, 91%, 92%, 93%, 94%, 95%, 96%, 97%, 98%, or 99% sequence identity thereto.
2. The TCR or antigen-binding fragment thereof of embodiment 1, wherein:
the Vα region comprises a complementarity determining region 3 (CDR-3) comprising the amino acid sequence AX2X3X4X5X6X7X8X9X10X11X12X13X14 (SEQ ID NO:1185), wherein X2 is A, G, V, Q, M, or E; X3 is S, G, N, A, Y, R, or P; X4 is E, S, A, G, F, N, D, V, P, L, I, M, or R; X5 is R, N, H, T, D, G, S, P, L, Q, or F; X6 is G, H, A, S, T, or null; X7 is T, S, G, or null; X8 is G, or null; X9 is G, N, S, or null; X10 is T, G, S, D, F, Y, A, or N; X11 is Y, F, Q, R, or N; X12 is K, Q, or D; X13 is Y, L, T, M, F, or V; X14 is I, T, S, R, Y, or V;
the Vα region comprises a complementarity determining region 3 (CDR-3) comprising the amino acid sequence X1X2X3X4X5X6X7X8X9X10X11X121 (SEQ ID NO:1186), wherein X1 is A, or V; X2 is A, V, or E; X3 is S, N, T, R, or P; X4 is E, A, G, F, V, P, I, D, or S; X5 is R, H, T, A P, S, G, or F; X6 is G, H, L, T, S, or A, null; X7 is S, T, or null; X8 is G, or null; X9 is G, T, or null; X10 is F, Y, or N; X12 is Y, T, or L;
the Vα region comprises a complementarity determining region 3 (CDR-3) comprising the amino acid sequence AX2X3X4X5X6X7X8X9YKYI (SEQ ID NO:1187), wherein X2 is A, V, or E; X3 is S, N, or R; X4 is E, G, V, P, I, or D; X5 is R, T, P, S, G, or F; X6 is G, T, S, or null; X7 is S, or null; X8 is G, or null; X9 is T, or null;

the Vα region comprises a complementarity determining region 3 (CDR-3) comprising the amino acid sequence AX2X3X4X5X6X7X8X9X10X11X12X13X14 (SEQ ID NO:1188), wherein X2 is G, V, Q, or M; X3 is G, A, Y, S, N, or R; X4 is S, G, L, I, M, or R; X5 is N, D, G, S, L, Q, or R; X6 is A, S, G, or null; X7 is G, or null; X8 is G, or null; X9 is G, N, S, or null; X10 is S, D, Y, A, N, or null; X11 is Y, Q, or R; X12 is K, or Q; X13 is L, or V; X14 is S, T, or V;

the Vα region comprises a complementarity determining region 3 (CDR-3) comprising the amino acid sequence AX2X3X4X5X6X7X8X9X10X11X12X13T (SEQ ID NO: 1189), wherein X2 is G, V, or Q; X3 is G, Y, S, or N; X4 is S, L, or M; X5 is N, G, L, or R; X6 is A, S, G, or null; X7 is G, or null; X8 is G, or null; X9 is G, S, or null; X10 is S, Y, A, N, or null; X11 is Y, Q, or R; X12 is K, or Q; X13 is L, or V;

the Vα region comprises a complementarity determining region 3 (CDR-3) comprising the amino acid sequence AX2X3X4X5X6X7YKLS (SEQ ID NO:1190), wherein X2 is G, or V; X3 is A, or Y; X4 is G, S, or R; X5 is D, or S; X6 is N, or null; X7 is D, or null.

3. The TCR or antigen-binding fragment thereof of embodiment 1 or embodiment 2, wherein:

the Vβ region comprises a complementarity determining region 3 (CDR-3) comprising the amino acid sequence AX2X3X4X5X6X7X8X9X10X11X12X13X14 (SEQ ID NO:1200), X2 is S, V, or I; X3 is S, N, or A; X4 is R, V, S, L, P, G, I, or A; X5 is F, G, Y, L, V, R, T, or S; X6 is L, G, A, D, R, V, or null; X7 is G, D, R, S, T, or null; X8 is S, or null; X9 is S, H, G, V, T, D, L, or null; X10 is T, S, A, G, P, N, or Y; X11 is D, Y, E, G, or N; X12 is T, E, G, or K; X13 is Q, Y, or L; X14 is Y, F, T, or I;

the Vβ region comprises a complementarity determining region 3 (CDR-3) comprising the amino acid sequence ASSX4X5X6X7X8X9X10X11X12X13X14 (SEQ ID NO:1201), wherein X4 is R, V, S, L, G, or A; X5 is F, G, Y, L, V, T, or S; X6 is A, L, R, D, G, or null; X7 is G, D, T, or null; X8 is S, or null; X9 is S, H, G, T, D, L, or null; X10 is T, S, A, G, P, N, or Y; X11 is D, Y, E, G, or N; X12 is T, E, or G; X13 is Q, Y, or L; X14 is Y, F, or T;

the Vβ region comprises a complementarity determining region 3 (CDR-3) comprising the amino acid sequence ASSX4X5X6X7X8X9X10TQY (SEQ ID NO: 1202), wherein X4 is R, L, or G; X5 is F, V, T, or Y; X6 is L, or A, null; X7 is G, or null; X8 is S, G, or null; X9 is T, G, P, or S; X10 is D, or E.

4. A T cell receptor (TCR) or antigen-binding fragment thereof, comprising an alpha chain comprising a variable alpha (Vα) region and a beta chain comprising a variable beta (Vβ) region, wherein:

the Vα region comprises a complementarity determining region 3 (CDR-3) comprising the amino acid sequence AX2X3X4X5X6X7X8X9X10X11X12X13X14 (SEQ ID NO:1185), wherein X2 is A, G, V, Q, M, or E; X3 is S, G, N, A, Y, R, or P; X4 is E, S, A, G, F, N, D, V, P, L, I, M, or R; X5 is R, N, H, T, D, G, S, P, L, Q, or F; X6 is G, H, A, S, T, or null; X7 is T, S, G, or null; X8 is G, or null; X9 is G, N, S, or null; X10 is T, G, S, D, F, Y, A, or N; X11 is Y, F, Q, R, or N; X12 is K, Q, or D; X13 is Y, L, T, M, F, or V; X14 is I, T, S, R, Y, or V;

the Vα region comprises a complementarity determining region 3 (CDR-3) comprising the amino acid sequence X1X2X3X4X5X6X7X8X9X10X11X121 (SEQ ID NO:1186), wherein X1 is A, or V; X2 is A, V, or E; X3 is S, N, T, R, or P; X4 is E, A, G, F, V, P, I, D, or S; X5 is R, H, T, A P, S, G, or F; X6 is G, H, L, T, S, or A, null; X7 is S, T, or null; X8 is G, or null; X9 is G, T, or null; X10 is F, Y, or N; X12 is Y, T, or L;

the Vα region comprises a complementarity determining region 3 (CDR-3) comprising the amino acid sequence AX2X3X4X5X6X7X8X9YKYI (SEQ ID NO:1187), wherein X2 is A, V, or E; X3 is S, N, or R; X4 is E, G, V, P, I, or D; X5 is R, T, P, S, G, or F; X6 is G, T, S, or null; X7 is S, or null; X8 is G, or null; X9 is T, or null;

the Vα region comprises a complementarity determining region 3 (CDR-3) comprising the amino acid sequence AX2X3X4X5X6X7X8X9X10X11X12X13X14 (SEQ ID NO:1188), wherein X2 is G, V, Q, or M; X3 is G, A, Y, S, N, or R; X4 is S, G, L, I, M, or R; X5 is N, D, G, S, L, Q, or R; X6 is A, S, G, or null; X7 is G, or null; X8 is G, or null; X9 is G, N, S, or null; X10 is S, D, Y, A, N, or null; X11 is Y, Q, or R; X12 is K, or Q; X13 is L, or V; X14 is S, T, or V;

the Vα region comprises a complementarity determining region 3 (CDR-3) comprising the amino acid sequence AX2X3X4X5X6X7X8X9X10X11X12X13T (SEQ ID NO: 1189), wherein X2 is G, V, or Q; X3 is G, Y, S, or N; X4 is S, L, or M; X5 is N, G, L, or R; X6 is A, S, G, or null; X7 is G, or null; X8 is G, or null; X9 is G, S, or null; X10 is S, Y, A, N, or null; X11 is Y, Q, or R; X12 is K, or Q; X13 is L, or V;

the Vα region comprises a complementarity determining region 3 (CDR-3) comprising the amino acid sequence AX2X3X4X5X6X7YKLS (SEQ ID NO:1190), wherein X2 is G, or V; X3 is A, or Y; X4 is G, S, or R; X5 is D, or S; X6 is N, or null; X7 is D, or null.

5. A T cell receptor (TCR) or antigen-binding fragment thereof, comprising an alpha chain comprising a variable alpha (Vα) region and a beta chain comprising a variable beta (Vβ) region, wherein:

the Vβ region comprises a complementarity determining region 3 (CDR-3) comprising the amino acid sequence AX2X3X4X5X6X7X8X9X10X11X12X13X14 (SEQ ID NO:1200), X2 is S, V, or I; X3 is S, N, or A; X4 is R, V, S, L, P, G, I, or A; X5 is F, G, Y, L, V, R, T, or S; X6 is L, G, A, D, R, V, or null; X7 is G, D, R, S, T, or null; X8 is S, or null; X9 is S, H, G, V, T, D, L, or null; X10 is T, S, A, G, P, N, or Y; X11 is D, Y, E, G, or N; X12 is T, E, G, or K; X13 is Q, Y, or L; X14 is Y, F, T, or I;

the Vβ region comprises a complementarity determining region 3 (CDR-3) comprising the amino acid sequence ASSX4X5X6X7X8X9X10X11X12X13X14 (SEQ ID NO:1201), wherein X4 is R, V, S, L, G, or A; X5 is F, G, Y, L, V, T, or S; X6 is A, L, R, D, G, or null; X7 is G, D, T, or null; X8 is S, or null; X9 is S, H, G, T, D, L, or null; X10 is T, S, A, G, P, N, or Y; X11 is D, Y, E, G, or N; X12 is T, E, or G; X13 is Q, Y, or L; X14 is Y, F, or T;

the Vβ region comprises a complementarity determining region 3 (CDR-3) comprising the amino acid sequence ASSX4X5X6X7X8X9X10TQY (SEQ ID NO: 1202), wherein X4 is R, L, or G; X5 is F, V, T, or Y; X6 is L, or A, null; X7 is G, or null; X8 is S, G, or null; X9 is T, G, P, or S; X10 is D, or E.

6. A T cell receptor (TCR) or antigen-binding fragment thereof, comprising an alpha chain comprising a variable alpha (Vα) region and a beta chain comprising a variable beta (Vβ) region, wherein:
the Vα region comprises a complementarity determining region 3 (CDR-3) set forth in any of SEQ ID NOs: 694, 712, 729, 744, 762, 776, 788, 802, 818, 832, 846, 858, 870, 882, 896, 911, 926, 940, 952, 964, 976, 988, 1002 or a sequence that exhibits at least 60%, 65%, 70%, 75%, 80%, 85%, 90% or 95% sequence identity thereto;
the Vβ region comprises a complementarity determining region 3 (CDR-3) set forth in any of SEQ ID NOs: 703, 721, 736, 753, 769, 782, 794, 809, 825, 840, 852, 864, 876, 888, 902, 919, 932, 946, 958, 970, 982, 994, or 1010 or a sequence that exhibits at least 60%, 65%, 70%, 75%, 80%, 85%, 90% or 95% sequence identity thereto.

7. The TCR or antigen-binding fragment thereof of any of embodiments 1-6, wherein the Vα region comprises:
a complementarity determining region 1 (CDR-1) comprising the amino acid sequence X1X2X3X4X5X6 (SEQ ID NO: 1191), wherein X1 is N, S, D, T, or V; X2 is S, V, R, T, or I; X3 is M, F, G, S, N, A, L, V, or P; X4 is F, S, N, A, or null; X5 is D, S, Q, Y, N, V, T, or P; and X6 is Y, S, R, N, G, or T; and/or
a complementarity determining region 2 (CDR-2) comprising the amino acid sequence X1X2X3X4X5X6X7X8 (SEQ ID NO: 1192), wherein X1 is I, V, L, G, N, T, Y, or M; X2 is S, V, Y, L, P, F, I, or T; X3 is S, Y, K, L, T, or F; X4 is I, G, N, A, S, or null; X5 is S, D, or null; X6 is K, G, N, S, D, T, or E; X7 is D, E, G, A, K, L, or N; and X8 is K, V, D, P, N, T, L, or M.

8. The TCR or antigen-binding fragment thereof of any of embodiments 1-7, wherein the Vβ region comprises:
a complementarity determining region 1 (CDR-1) comprising the amino acid sequence SX2X3X4X5 (SEQ ID NO:1203), wherein X2 is G, or N; X3 is H, or D; X4 is T, L, N, or V; and X5 is A, S, Y, or T; and/or
a complementarity determining region 2 (CDR-2) comprising the amino acid sequence X1X2X3X4X5X6 (SEQ ID NO:1204), wherein X1 is F, or Y; X2 is Q, Y, or N; X3 is G, N, R, or Y; X4 is N, G, E, or T; X5 is S, E, A, or G; and X6 is A, E, I, or Q.

9. The TCR or antigen-binding fragment thereof of any of embodiments 1-8, wherein the TCR or antigen-binding fragment thereof binds to or recognizes a peptide epitope of human papillomavirus (HPV) 16 E7 in the context of an MHC molecule, the peptide epitope is or comprises E7(11-19) YMLDLQPET (SEQ ID NO:236).

10. The TCR or antigen-binding fragment of any of embodiments 1-9, wherein:
the Vα region comprises a complementarity determining region 3 (CDR-3) comprising the amino acid sequence set forth in any of SEQ ID NOs: 694, 712, 729, 744, 762, 776, 788, 802, 818, 832, 846, 858, 870, 882, 896, 911, 926, 940, 952, 964, 976, 988 or 1002, or a CDR3 contained within the amino acid sequence set forth in any of SEQ ID NOs: 691, 709, 726, 741, 759, 775, 787, 799, 815, 830, 845, 857, 869, 881, 895, 908, 925, 937, 951, 963, 975, 987 or 999; and/or
the Vβ region comprises a complementarity determining region 3 (CDR-3) comprising an amino acid sequence set forth in any of SEQ ID NOs: 703, 721, 736, 753, 769, 782, 794, 809, 825, 840, 852, 864, 876, 888, 902, 919, 932, 946, 958, 970, 982, 994, 1010, or 1381, or a CDR3 contained within the amino acid sequence set forth in any of SEQ ID NOs: 700, 718, 735, 750, 768, 781, 793, 808, 824, 839, 851, 863, 875, 887, 901, 917, 931, 945, 957, 969, 981, 993 or 1008, or 1380.

11. The TCR or antigen-binding fragment thereof of any of embodiments 1-10, wherein the Vα region further comprises:
a complementarity determining region 1 (CDR-1) comprising an amino acid sequence set forth in any of SEQ ID NOs: 171, 692, 710, 727, 742, 760, 171, 800, 816, 570, 909, 938, 151, 1000; and/or
a complementarity determining region 2 (CDR-2) comprising an amino acid sequence set forth in any of SEQ ID NOs: 172, 693, 711, 728, 743, 761, 172, 801, 817, 831, 571, 910, 939, 152, or 1001.

12. The TCR or antigen-binding fragment thereof of any of embodiments 1-11, wherein the Vβ region comprises:
a complementarity determining region 1 (CDR-1) comprising the amino acid sequence set forth in any of SEQ ID NOs: 701, 719, 154, 751 or 139; and/or
a complementarity determining region 2 (CDR-2) comprising the amino acid sequence set forth in any of SEQ ID NOs: 702, 720, 155, 752, 140 or 918.

13. The TCR or antigen-binding fragment thereof of any of embodiments 1-12, wherein:
the Vα region comprises a CDR-1, CDR-2, and CDR-3, comprising the amino acid sequences of SEQ ID NOs: 692, 693, and 694, respectively, and the Vβ region comprises a CDR-1, CDR-2, and CDR-3, comprising the amino acid sequences of SEQ ID NOs: 701, 702 and 703, respectively;
the Vα region comprises a CDR-1, CDR-2, and CDR-3, comprising the amino acid sequences of SEQ ID NOs: 710, 711, and 712, respectively, and the Vβ region comprises a CDR-1, CDR-2, and CDR-3, comprising the amino acid sequences of SEQ ID NOs: 719, 720 and 721, respectively;
the Vα region comprises a CDR-1, CDR-2, and CDR-3, comprising the amino acid sequences of SEQ ID NOs: 727, 728 and 729, respectively, and the Vβ region comprises a CDR-1, CDR-2, and CDR-3, comprising the amino acid sequences of SEQ ID NOs: 154, 155 and 736, respectively;
the Vα region comprises a CDR-1, CDR-2, and CDR-3, comprising the amino acid sequences of SEQ ID NOs: 742, 743 and 744, respectively, and the Vβ region comprises a CDR-1, CDR-2, and CDR-3, comprising the amino acid sequences of SEQ ID NOs: 751, 752 and 753, respectively;
the Vα region comprises a CDR-1, CDR-2, and CDR-3, comprising the amino acid sequences of SEQ ID NOs: 760, 761 and 762, respectively, and the Vβ region comprises a CDR-1, CDR-2, and CDR-3, comprising the amino acid sequences of SEQ ID NOs: 719, 720 and 769, respectively;
the Vα region comprises a CDR-1, CDR-2, and CDR-3, comprising the amino acid sequences of SEQ ID NOs: 171, 172 and 776, respectively, and the Vβ region comprises a CDR-1, CDR-2, and CDR-3, comprising the amino acid sequences of SEQ ID NOs: 154, 155 and 782, respectively;
the Vα region comprises a CDR-1, CDR-2, and CDR-3, comprising the amino acid sequences of SEQ ID NOs: 742, 743 and 788, respectively, and the Vβ region comprises a CDR-1, CDR-2, and CDR-3, comprising the amino acid sequences of SEQ ID NOs: 139, 140 and 794, respectively;

the Vα region comprises a CDR-1, CDR-2, and CDR-3, comprising the amino acid sequences of SEQ ID NOs: 800, 801 and 802, respectively, and the Vβ region comprises a CDR-1, CDR-2, and CDR-3, comprising the amino acid sequences of SEQ ID NOs: 751, 752 and 809, respectively;

the Vα region comprises a CDR-1, CDR-2, and CDR-3, comprising the amino acid sequences of SEQ ID NOs: 816, 817 and 818, respectively, and the Vβ region comprises a CDR-1, CDR-2, and CDR-3, comprising the amino acid sequences of SEQ ID NOs: 154, 155 and 825, respectively;

the Vα region comprises a CDR-1, CDR-2, and CDR-3, comprising the amino acid sequences of SEQ ID NOs: 816, 831 and 832, respectively, and the Vβ region comprises a CDR-1, CDR-2, and CDR-3, comprising the amino acid sequences of SEQ ID NOs: 154, 155 and 840, respectively;

the Vα region comprises a CDR-1, CDR-2, and CDR-3, comprising the amino acid sequences of SEQ ID NOs: 171, 172 and 846, respectively, and the Vβ region comprises a CDR-1, CDR-2, and CDR-3, comprising the amino acid sequences of SEQ ID NOs: 154, 155 and 852, respectively;

the Vα region comprises a CDR-1, CDR-2, and CDR-3, comprising the amino acid sequences of SEQ ID NOs: 816, 833 and 858, respectively, and the Vβ region comprises a CDR-1, CDR-2, and CDR-3, comprising the amino acid sequences of SEQ ID NOs: 154, 155 and 864, respectively;

the Vα region comprises a CDR-1, CDR-2, and CDR-3, comprising the amino acid sequences of SEQ ID NOs: 727, 728 and 870, respectively, and the Vβ region comprises a CDR-1, CDR-2, and CDR-3, comprising the amino acid sequences of SEQ ID NOs: 154, 155 and 876, respectively;

the Vα region comprises a CDR-1, CDR-2, and CDR-3, comprising the amino acid sequences of SEQ ID NOs: 570, 571 and 882, respectively, and the Vβ region comprises a CDR-1, CDR-2, and CDR-3, comprising the amino acid sequences of SEQ ID NOs: 719, 720 and 888, respectively;

the Vα region comprises a CDR-1, CDR-2, and CDR-3, comprising the amino acid sequences of SEQ ID NOs: 816, 817 and 896, respectively, and the Vβ region comprises a CDR-1, CDR-2, and CDR-3, comprising the amino acid sequences of SEQ ID NOs: 701, 702 and 902, respectively;

the Vα region comprises a CDR-1, CDR-2, and CDR-3, comprising the amino acid sequences of SEQ ID NOs: 909, 910 and 911, respectively, and the Vβ region comprises a CDR-1, CDR-2, and CDR-3, comprising the amino acid sequences of SEQ ID NOs: 701, 702 and 919, respectively;

the Vα region comprises a CDR-1, CDR-2, and CDR-3, comprising the amino acid sequences of SEQ ID NOs: 727, 728 and 926, respectively, and the Vβ region comprises a CDR-1, CDR-2, and CDR-3, comprising the amino acid sequences of SEQ ID NOs: 154, 155 and 932, respectively;

the Vα region comprises a CDR-1, CDR-2, and CDR-3, comprising the amino acid sequences of SEQ ID NOs: 938, 939 and 940, respectively, and the Vβ region comprises a CDR-1, CDR-2, and CDR-3, comprising the amino acid sequences of SEQ ID NOs: 154, 155 and 946, respectively;

the Vα region comprises a CDR-1, CDR-2, and CDR-3, comprising the amino acid sequences of SEQ ID NOs: 727, 728 and 952, respectively, and the Vβ region comprises a CDR-1, CDR-2, and CDR-3, comprising the amino acid sequences of SEQ ID NOs: 154, 155 and 958, respectively;

the Vα region comprises a CDR-1, CDR-2, and CDR-3, comprising the amino acid sequences of SEQ ID NOs: 151,152 and 964, respectively, and the Vβ region comprises a CDR-1, CDR-2, and CDR-3, comprising the amino acid sequences of SEQ ID NOs: 719, 720 and 970, respectively;

the Vα region comprises a CDR-1, CDR-2, and CDR-3, comprising the amino acid sequences of SEQ ID NOs: 727, 728 and 976, respectively, and the Vβ region comprises a CDR-1, CDR-2, and CDR-3, comprising the amino acid sequences of SEQ ID NOs: 154, 155 and 982, respectively;

the Vα region comprises a CDR-1, CDR-2, and CDR-3, comprising the amino acid sequences of SEQ ID NOs: 710, 711 and 988, respectively, and the Vβ region comprises a CDR-1, CDR-2, and CDR-3, comprising the amino acid sequences of SEQ ID NOs: 719, 729 and 994, respectively;

the Vα region comprises a CDR-1, CDR-2, and CDR-3, comprising the amino acid sequences of SEQ ID NOs: 1000, 1001 and 1002, respectively, and the Vβ region comprises a CDR-1, CDR-2, and CDR-3, comprising the amino acid sequences of SEQ ID NOs: 139, 1009 and 1010, respectively; or the Vα region comprises a CDR-1, CDR-2, and CDR-3, comprising the amino acid sequences of SEQ ID NOs: 171, 172, and 1391, respectively, and the Vβ region comprises a CDR-1, CDR-2, and CDR-3, comprising the amino acid sequences of SEQ ID NOs: 154, 155, and 1381, respectively.

14. The TCR or antigen-binding fragment thereof of any of embodiments 1-13, wherein:

the Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 691, 709, 726, 741, 759, 775, 787, 799, 815, 830, 845, 857, 869, 881, 895, 908, 925, 937, 951, 963, 975, 987, 999, or 1390; and/or the Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 700, 718, 735, 750, 768, 781, 793, 808, 824, 839, 851, 863, 875, 887, 901, 917, 931, 945, 957, 969, 981, 993, 1008, or 1380.

15. The TCR or antigen-binding fragment thereof of any of embodiments 1-14, wherein:

the Vα and Vβ regions comprise the amino acid sequences of SEQ ID NOs: 691 and 700, respectively; the Vα and Vβ regions comprise the amino acid sequences of SEQ ID NOs: 709 and 718, respectively; the Vα and Vβ regions comprise the amino acid sequences of SEQ ID NOs:726 and 735, respectively; the Vα and Vβ regions comprise the amino acid sequences of SEQ ID NOs:741 and 750, respectively;

the Vα and Vβ regions comprise the amino acid sequences of SEQ ID NOs:759 and 768, respectively;
the Vα and Vβ regions comprise the amino acid sequences of SEQ ID NOs:775 and 781, respectively;
the Vα and Vβ regions comprise the amino acid sequences of SEQ ID NOs:787 and 793, respectively;
the Vα and Vβ regions comprise the amino acid sequences of SEQ ID NOs:799 and 808, respectively;
the Vα and Vβ regions comprise the amino acid sequences of SEQ ID NOs:815 and 824, respectively;
the Vα and Vβ regions comprise the amino acid sequences of SEQ ID NOs:830 and 839, respectively;
the Vα and Vβ regions comprise the amino acid sequences of SEQ ID NOs:845 and 851, respectively;
the Vα and Vβ regions comprise the amino acid sequences of SEQ ID NOs:857 and 863, respectively;
the Vα and Vβ regions comprise the amino acid sequences of SEQ ID NOs:869 and 875, respectively;
the Vα and Vβ regions comprise the amino acid sequences of SEQ ID NOs:881 and 887, respectively;
the Vα and Vβ regions comprise the amino acid sequences of SEQ ID NOs:895 and 901, respectively;
the Vα and Vβ regions comprise the amino acid sequences of SEQ ID NOs:908 and 917, respectively;
the Vα and Vβ regions comprise the amino acid sequences of SEQ ID NOs:925 and 931, respectively;
the Vα and Vβ regions comprise the amino acid sequences of SEQ ID NOs:937 and 945, respectively;
the Vα and Vβ regions comprise the amino acid sequences of SEQ ID NOs:951 and 957, respectively;
the Vα and Vβ regions comprise the amino acid sequences of SEQ ID NOs:963 and 969, respectively;
the Vα and Vβ regions comprise the amino acid sequences of SEQ ID NOs:975 and 981, respectively;
the Vα and Vβ regions comprise the amino acid sequences of SEQ ID NOs:987 and 993, respectively;
the Vα and Vβ regions comprise the amino acid sequences of SEQ ID NOs:999 and 1008, respectively;
or the Vα and Vβ regions comprise the amino acid sequences of SEQ ID NOs: 1390 and 1380, respectively.

16. The TCR or antigen-binding fragment thereof of any of embodiments 1-15, wherein the alpha chain further comprises an alpha constant (Cα) region and/or the beta chain further comprises a beta constant (Cβ) region.

17. The TCR or antigen-binding fragment thereof of embodiment 16, wherein the Cα and Cβ regions are mouse constant regions.

18. The TCR or antigen-binding fragment thereof of embodiment 16 or embodiment 17, wherein:
the Cα region comprises the amino acid sequence set forth in SEQ ID NO: 262, 833, 1012, 1014, 1015, 1017, 1018, or a sequence of amino acids that has at least 90% sequence identity thereto; and/or
the Cβ region comprises the amino acid sequence set forth in SEQ ID NO: 263, 1013 or 1016 or a sequence of amino acids that has at least 90% sequence identity thereto.

19. The TCR or antigen-binding fragment thereof of embodiment 16, wherein the Cα and Cβ regions are human constant regions.

20. The TCR or antigen-binding fragment thereof of embodiment 16 or embodiment 19, wherein:
the Cα region comprises the amino acid sequence set forth in any of SEQ ID NOs: 212, 213, 215, 217, 218, 220 or 524, or a sequence of amino acids that has at least 90% sequence identity thereto; and/or
the Cβ region comprises the amino acid sequence set forth in any of SEQ ID NOs: 214, 216, 631 or 889, or a sequence of amino acids that has at least 90% sequence identity thereto.

21. The TCR or antigen-binding fragment thereof of any of embodiments 1-20, wherein:
a) the alpha chain comprises:
the amino acid sequence set forth in any of SEQ ID NOs: 687, 705, 722, 737, 755, 771, 783, 795, 811, 826, 841, 853, 865, 877, 891, 904, 921, 933, 947, 959, 971, 983, 995, 1386, a sequence of amino acids that has at least 90% sequence identity thereto; or the amino acid sequence encoded by the nucleotide sequence set forth in any of SEQ ID NOs: 1049, 1051, 1055, 1057, 1059, 1061, 1063, 1065, 1067, 1069, 1071, 1073, 1075, 1077, 1079, 1081, 1083, 1085, 1087, 1089, 1091, or a nucleotide sequence that has at least 90% sequence identity thereto; and/or
b) the beta chain comprises:
the amino acid sequence set forth in any of SEQ ID NOs: 696, 714, 731, 746, 764, 777, 789, 804, 820, 835, 847, 859, 871, 883, 897, 913, 927, 941, 953, 965, 977, 989, 1004, or 1376, a sequence of amino acids that has at least 90% sequence identity thereto; or the amino acid sequence encoded by the nucleotide sequence set forth in SEQ ID NOS: 1050, 1052, 1056, 1058, 1060, 1062, 1064, 1066, 1068, 1070, 1072, 1074, 1076, 1078, 1080, 1082, 1084, 1086, 1088, 1090 or 1092, or a nucleotide sequence that has at least 90% sequence identity thereto.

22. The TCR or antigen-binding fragment thereof of any of embodiments 1-20, wherein:
the alpha and beta chains comprise the amino acid sequences of SEQ ID NOs: 687 and 696, respectively;
the alpha and beta chains comprise the amino acid sequences of SEQ ID NOs: 705 and 714, respectively;
the alpha and beta chains comprise the amino acid sequences of SEQ ID NOs: 722 and 731, respectively;
the alpha and beta chains comprise the amino acid sequences of SEQ ID NOs: 737 and 746, respectively;
the alpha and beta chains comprise the amino acid sequences of SEQ ID NOs: 755 and 764, respectively;
the alpha and beta chains comprise the amino acid sequences of SEQ ID NOs: 771 and 777, respectively;
the alpha and beta chains comprise the amino acid sequences of SEQ ID NOs: 783 and 789, respectively;
the alpha and beta chains comprise the amino acid sequences of SEQ ID NOs: 795 and 804, respectively;
the alpha and beta chains comprise the amino acid sequences of SEQ ID NOs: 811 and 820, respectively;
the alpha and beta chains comprise the amino acid sequences of SEQ ID NOs: 826 and 835, respectively;
the alpha and beta chains comprise the amino acid sequences of SEQ ID NOs: 841 and 847, respectively;
the alpha and beta chains comprise the amino acid sequences of SEQ ID NOs: 853 and 859, respectively;
the alpha and beta chains comprise the amino acid sequences of SEQ ID NOs: 865 and 871, respectively;
the alpha and beta chains comprise the amino acid sequences of SEQ ID NOs: 877 and 883, respectively;
the alpha and beta chains comprise the amino acid sequences of SEQ ID NOs: 891 and 897, respectively;
the alpha and beta chains comprise the amino acid sequences of SEQ ID NOs: 904 and 913, respectively;

the alpha and beta chains comprise the amino acid sequences of SEQ ID NOs: 921 and 927, respectively; the alpha and beta chains comprise the amino acid sequences of SEQ ID NOs: 933 and 941, respectively; the alpha and beta chains comprise the amino acid sequences of SEQ ID NOs: 947 and 953, respectively; the alpha and beta chains comprise the amino acid sequences of SEQ ID NOs: 959 and 965, respectively; the alpha and beta chains comprise the amino acid sequences of SEQ ID NOs: 971 and 977, respectively; the alpha and beta chains comprise the amino acid sequences of SEQ ID NOs: 983 and 989, respectively; the alpha and beta chains comprise the amino acid sequences of SEQ ID NOs: 995 and 1004, respectively; or the alpha and beta chains comprise the amino acid sequences of SEQ ID NOs: 1386 and 1376, respectively.

23. The TCR or antigen-binding fragment thereof of any of embodiments 1-19, wherein the TCR or antigen-binding fragment comprises one or more modifications in the α chain and/or β chain such that when the TCR or antigen-binding fragment thereof is expressed in a cell, the frequency of mispairing between the TCR α chain and β chain and an endogenous TCR α chain and β chain is reduced, the expression of the TCR α chain and β chain is increased and/or the stability of the TCR α chain and β chain is increased, each compared to expression in a cell of the TCR or antigen-binding fragment thereof not containing the one or more modifications.

24. The TCR or antigen-binding fragment thereof of embodiment 23, wherein the one or more modifications is a replacement, deletion, or insertion of one or more amino acids in the Cα region and/or the Cβ region.

25. The TCR or antigen-binding fragment thereof of embodiment 23 or embodiment 24, wherein the one or more modifications comprise replacement(s) to introduce one or more cysteine residues that are capable of forming one or more non-native disulfide bridges between the alpha chain and beta chain.

26. The TCR or antigen-binding fragment thereof of any of embodiments 1-16, 19 and 23-25, comprising a Cα region comprising a cysteine at a position corresponding to position 48 with numbering as set forth in SEQ ID NO: 212, 213, 217, 218, or 524 or at a position corresponding to position 49 with numbering as set forth in SEQ ID NO: 215 or 220; and/or a Cβ region comprising a cysteine at a position corresponding to position 57 with numbering as set forth in SEQ ID NO: 214 or 216 or at a position corresponding to position 58 with numbering as set forth in SEQ ID NO: 631 or 889.

27. The TCR or antigen-binding fragment thereof of any of embodiments 16, 19, and 23-26, wherein:
the Cα region comprises the amino acid sequence set forth in any of SEQ ID NOs: 196, 198, 200, 201, 203, or 525, or a sequence of amino acids that has at least 90% sequence identity thereto comprising one or more cysteine residues capable of forming a non-native disulfide bond with the beta chain; and/or
the Cβ region comprises the amino acid sequence set forth in any of SEQ ID NOs: 197,199, 632, or 890 or a sequence of amino acids that has at least 90% sequence identity thereto that contains one or more cysteine residues capable of forming a non-native disulfide bond with the alpha chain.

28. The TCR or antigen-binding fragment thereof of any of embodiments 1-27, wherein the TCR or antigen-binding fragment thereof is encoded by a nucleotide sequence that has been codon-optimized.

29. The TCR or antigen-binding fragment thereof of any of embodiments 1-19 and 23-28, wherein:
a) the alpha chain comprises:
the amino acid sequence set forth in any of SEQ ID NOs: 688, 706, 723, 738, 756, 772, 784, 796, 812, 827, 842, 854, 866, 878, 892, 905, 922, 934, 948, 960, 972, 984, 996, or 1387, a sequence of amino acids that has at least 90% sequence identity thereto; or the amino acid sequence encoded by the nucleotide sequence set forth in any of SEQ ID NOs: 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, or 1385, or a nucleotide sequence that has at least 90% sequence identity thereto; and/or
b) the beta chain comprises:
the amino acid sequence set forth in any of SEQ ID NOs: 697, 715, 732, 747, 765, 778, 790, 805, 821, 836, 848, 860, 872, 884, 898, 914, 928, 942, 954, 966, 978, 990, 1005, or 1377, a sequence of amino acids that has at least 90% sequence identity thereto; or the amino acid sequence encoded by the nucleotide sequence set forth in SEQ ID NOS: 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, or 1375, or a nucleotide sequence that has at least 90% sequence identity thereto.

30. The TCR or antigen-binding fragment thereof of any of embodiments 1-19 and 23-29, wherein: the alpha and beta chains comprise the amino acid sequences of SEQ ID NOs: 688 and 697, respectively; the alpha and beta chains comprise the amino acid sequences of SEQ ID NOs: 706 and 715, respectively; the alpha and beta chains comprise the amino acid sequences of SEQ ID NOs: 723 and 732, respectively; the alpha and beta chains comprise the amino acid sequences of SEQ ID NOs: 738 and 747, respectively; the alpha and beta chains comprise the amino acid sequences of SEQ ID NOs: 756 and 765, respectively; the alpha and beta chains comprise the amino acid sequences of SEQ ID NOs: 772 and 778, respectively; the alpha and beta chains comprise the amino acid sequences of SEQ ID NOs: 784 and 790, respectively; the alpha and beta chains comprise the amino acid sequences of SEQ ID NOs: 796 and 805, respectively; the alpha and beta chains comprise the amino acid sequences of SEQ ID NOs: 812 and 821, respectively; the alpha and beta chains comprise the amino acid sequences of SEQ ID NOs: 827 and 836, respectively; the alpha and beta chains comprise the amino acid sequences of SEQ ID NOs: 842 and 848, respectively; the alpha and beta chains comprise the amino acid sequences of SEQ ID NOs: 854 and 860, respectively; the alpha and beta chains comprise the amino acid sequences of SEQ ID NOs: 866 and 872, respectively; the alpha and beta chains comprise the amino acid sequences of SEQ ID NOs: 878 and 884, respectively; the alpha and beta chains comprise the amino acid sequences of SEQ ID NOs: 892 and 898, respectively; the alpha and beta chains comprise the amino acid sequences of SEQ ID NOs: 905 and 914, respectively; the alpha and beta chains comprise the amino acid sequences of SEQ ID NOs: 922 and 928, respectively; the alpha and beta chains comprise the amino acid sequences of SEQ ID NOs: 934 and 942, respectively; the alpha and beta chains comprise the amino acid sequences of SEQ ID NOs: 948 and 954, respectively; the alpha and beta chains comprise the amino acid sequences of SEQ ID NOs: 960 and 966, respectively; the alpha and beta chains comprise the amino acid sequences of SEQ ID NOs: 972 and 978, respectively; the alpha and beta chains comprise the amino acid sequences of SEQ ID NOs: 984 and 990, respectively; the alpha and beta chains comprise the amino acid sequences of SEQ ID NOs: 996 and 1005, respectively; or the alpha and beta chains comprise the amino acid sequences of SEQ ID NOs: 1387 and 1377, respectively.

31. The TCR or antigen-binding fragment thereof of any of embodiments 1-30, wherein the alpha and/or beta chain further comprises a signal peptide.

32. The TCR or antigen-binding fragment thereof of embodiment 31, wherein:
the alpha chain comprises the signal peptide comprising the amino acid sequence set forth in any of SEQ ID NOs: 181, 184, 187, 189, 190, 192, 193, 310, 311; and/or
the beta chain comprises the signal peptide comprising the amino acid sequence set forth in any of SEQ ID NOs: 182, 185, 186, 188, 191, or 194.

33. The TCR or antigen-binding fragment thereof of any of embodiments 1-32, that is isolated or purified or is recombinant.

34. The TCR or antigen-binding fragment thereof of any of embodiments 1-33, that is human.

35. The TCR or antigen-binding fragment thereof of any of embodiments 1-34, that is monoclonal.

36. The TCR or antigen-binding fragment thereof of any of embodiments 1-35, wherein the TCR or antigen-binding fragment thereof is single chain.

37. The TCR or antigen-binding fragment thereof of any of embodiments 1-35, wherein the TCR or antigen-binding fragment thereof comprises two chains.

38. The TCR or antigen-binding fragment thereof of any of embodiments 1-37, wherein the antigen-specificity is at least partially CD8-independent.

39. The TCR or antigen-binding fragment of any of embodiments 9-38 wherein the MHC molecule is an HLA-A2 molecule.

40. A nucleic acid molecule encoding the TCR or antigen-binding fragment thereof of any of embodiments 1-39, or an alpha or beta chain thereof.

41. The nucleic acid molecule of embodiment 40, comprising a nucleotide sequence encoding an alpha chain and/or a nucleotide sequence encoding a beta chain, wherein:
the nucleotide sequence encoding an alpha chain comprises the sequence set forth in any of SEQ ID NOS: 1049, 1051, 1055, 1057, 1059, 1061, 1063, 1065, 1067, 1069, 1071, 1073, 1075, 1077, 1079, 1081, 1083, 1085, 1087, 1089, 1091, or a nucleotide sequence that has at least 90% sequence identity thereto;
the nucleotide sequence encoding a beta chain comprises the sequence set forth in SEQ ID NOS: 1050, 1052, 1056, 1058, 1060, 1062, 1064, 1066, 1068, 1070, 1072, 1074, 1076, 1078, 1080, 1082, 1084, 1086, 1088, 1090 or 1092, or a nucleotide sequence that has at least 90% sequence identity thereto.

42. The nucleic acid molecule of embodiment 40, wherein the nucleotide sequence is codon-optimized.

43. The nucleic acid molecule of embodiment 40 or embodiment 42, comprising a nucleotide sequence encoding an alpha chain and/or a nucleotide sequence encoding a beta chain, wherein:
the nucleotide sequence encoding an alpha chain comprises the sequence to set forth in any of SEQ ID NOS: 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, or 1385, or a nucleotide sequence that has at least 90% sequence identity thereto;
the nucleotide sequence encoding a beta chain comprises the sequence set forth in SEQ ID NOS: 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, or 1375, or a nucleotide sequence that has at least 90% sequence identity thereto.

44. The nucleic acid molecule of any of embodiments 40-43, wherein the nucleotide sequence encoding the alpha chain and the nucleotide sequence encoding the beta chain are separated by a peptide sequence that causes ribosome skipping.

45. The nucleic acid molecule of embodiment 44, wherein the peptide that causes ribosome skipping is a P2A or T2A peptide and/or comprises the sequence of amino acids set forth in SEQ ID NO: 204 or 211.

46. The nucleic acid molecule of any of embodiments 40-45, comprising the nucleotide sequence set forth in any of SEQ ID NOs: 448, 449, 450, 451, 452, 453, 454, 455, 456, 457, 458, 459, 460, 461, 462, 463, 464, 465, 466, 467, 468, 469, 470, 471, 472, or 1382, or a nucleotide sequence having at least 90% sequence identity thereto.

47. A T cell receptor (TCR) or antigen-binding fragment thereof, comprising an alpha chain comprising a variable alpha (Vα) region and a beta chain comprising a variable beta (Vβ) region, wherein:
the Vα region comprises the amino acid sequence set forth in any of SEQ ID NOs: 477, 492, 504, 510, 522, 536, 554, 569, 587, 599, 611, 623, 637, 649, 661 or 676, or an amino acid sequence that has at least 90%, 91%, 92%, 93%, 94%, 95%, 96%, 97%, 98%, or 99% sequence identity thereto; and/or
the Vβ region comprises the amino acid sequence set forth in any of SEQ ID NOs: 483, 498, 516, 530, 545, 560, 578, 593, 605, 617, 629, 643, 655, 667 or 685, or an amino acid sequence that has at least 90%, 91%, 92%, 93%, 94%, 95%, 96%, 97%, 98%, or 99% sequence identity thereto.

48. The TCR or antigen-binding fragment thereof of embodiment 47, wherein the Vα region comprises a complementarity determining region 3 (CDR-3) comprising the amino acid sequence AX2RX4AX6NNDMR, wherein X2 is V, or M; X4 is P, or D; and X6 is N, or R (SEQ ID NO: 1221).

49. The TCR or antigen-binding fragment thereof of embodiment 47 or embodiment 48, wherein:
the Vβ region comprises a complementarity determining region 3 (CDR-3) comprising the amino acid sequence ASSX4WGX7SNQPX12H, wherein X4 is L, F, or P; X7 is R, or Q; and X12 is Q, or L (SEQ ID NO: 1216); or
the Vβ region comprises a complementarity determining region 3 (CDR-3) comprising the amino acid sequence ASSX4X5X6X7X8SGNTIY, wherein X4 is L, or R; X5 is W, or Q; X6 is G, or P; X7 is R, or S; and X8 is S, or null (SEQ ID NO: 1217).

50. A T cell receptor (TCR) or antigen-binding fragment thereof, comprising an alpha chain comprising a variable alpha (Vα) region and a beta chain comprising a variable beta (Vβ) region, wherein the Vα region comprises a complementarity determining region 3 (CDR-3) comprising the amino acid sequence AX2RX4AX6NNDMR, wherein X2 is V, or M; X4 is P, or D; and X6 is N, or R (SEQ ID NO: 1221).

51. A T cell receptor (TCR) or antigen-binding fragment thereof, comprising an alpha chain comprising a variable alpha (Vα) region and a beta chain comprising a variable beta (Vβ) region, wherein:
the Vβ region comprises a complementarity determining region 3 (CDR-3) comprising the amino acid sequence ASSX4WGX7SNQPX12H, wherein X4 is L, F, or P; X7 is R, or Q; and X12 is Q, or L (SEQ ID NO: 1216); or
the Vβ region comprises a complementarity determining region 3 (CDR-3) comprising the amino acid sequence ASSX4X5X6X7X8SGNTIY, wherein X4 is L, or R; X5 is W, or Q; X6 is G, or P; X7 is R, or S; and X8 is S, or null(SEQ ID NO: 1217).

52. A T cell receptor (TCR) or antigen-binding fragment thereof, comprising an alpha chain comprising a variable alpha (Vα) region and a beta chain comprising a variable beta (Vβ) region, wherein:
the Vα region comprises a complementarity determining region 3 (CDR-3) set forth in any of SEQ ID NOs: 478, 493, 505, 511, 523, 539, 555, 572, 588, 600, 612, 624, 638, 650, 662 or 679, or a sequence that exhibits at least 60%, 65%, 70%, 75%, 80%, 85%, 90% or 95% sequence identity thereto;
the Vβ region comprises a complementarity determining region 3 (CDR-3) set forth in any of SEQ ID NOs: 486, 499, 517, 531, 548, 563, 581, 594, 606, 618, 630, 644, 656, 670 or 686, or a sequence that exhibits at least 60%, 65%, 70%, 75%, 80%, 85%, 90% or 95% sequence identity thereto.

53. The TCR or antigen-binding fragment thereof of any of embodiments 47-52, wherein the Vα region comprises:
a complementarity determining region 1 (CDR-1) comprising the amino acid sequence X1X2X3X4X5X6 (SEQ ID NO: 1191), wherein X1 is N, S, D, T, or V; X2 is S, V, R, T, or I; X3 is M, F, G, S, N, A, L, V, or P; X4 is F, S, N, A, or null; X5 is D, S, Q, Y, N, V, T, or P; and X6 is Y, S, R, N, G, or T; and/or
a complementarity determining region 2 (CDR-2) comprising the amino acid sequence X1X2X3X4X5X6X7X8 (SEQ ID NO:1192), wherein X1 is I, V, L, G, N, T, Y, or M; X2 is S, V, Y, L, P, F, I, or T; X3 is S, Y, K, L, T, or F; X4 is I, G, N, A, S, or null; X5 is S, D, or null; X6 is K, G, N, S, D, T, or E; X7 is D, E, G, A, K, L, or N; and X8 is K, V, D, P, N, T, L, or M.

54. The TCR or antigen-binding fragment thereof of any of embodiments 47-53, wherein the Vβ region comprises:
a complementarity determining region 1 (CDR-1) comprising the amino acid sequence SX2X3X4X5 (SEQ ID NO:1203), wherein X2 is G, or N; X3 is H, or D; X4 is T, L, N, or V; and X5 is A, S, Y, or T; and/or
a complementarity determining region 2 (CDR-2) comprising the amino acid sequence X1X2X3X4X5X6 (SEQ ID NO:1204), wherein X1 is F, or Y; X2 is Q, Y, or N; X3 is G, N, R, or Y; X4 is N, G, E, or T; X5 is S, E, A, or G; and X6 is A, E, I, or Q.

55. The TCR or antigen-binding fragment thereof of any of embodiments 47-54, wherein the TCR or antigen-binding fragment thereof binds to or recognizes a peptide epitope of human papillomavirus (HPV) 16 E6 in the context of an MHC molecule, the peptide epitope is or comprises E6(29-38) TIHDIILECV (SEQ ID NO:233).

56. The TCR or antigen-binding fragment of any of embodiments 47-55, wherein:
the Vα region comprises a complementarity determining region 3 (CDR-3) comprising the amino acid sequence set forth in any of SEQ ID NOs: 478, 493, 505, 511, 523, 539, 555, 572, 588, 600, 612, 624, 638, 650, 662 or 679, or a CDR3 contained within the amino acid sequence set forth in any of SEQ ID NOs: 477, 492, 504, 510, 522, 536, 554, 569, 587, 599, 611, 623, 637, 649, 661 or 676; and/or
the Vβ region comprises a complementarity determining region 3 (CDR-3) comprising an amino acid sequence set forth in any of SEQ ID NOs: 486, 499, 517, 531, 548, 563, 581, 594, 606, 618, 630, 644, 656, 670 or 686 or a CDR3 contained within the amino acid sequence set forth in any of SEQ ID NOs: 483, 498, 516, 530, 545, 560, 578, 593, 605, 617, 629, 643, 655, 667 or 685.

57. The TCR or antigen-binding fragment thereof of any of embodiments 47-56, wherein the Vα region further comprises:
a complementarity determining region 1 (CDR-1) comprising an amino acid sequence set forth in any of SEQ ID NOs: 136, 161, 165, 537, 570, 142, 171 or 677; and/or
a complementarity determining region 2 (CDR-2) comprising an amino acid sequence set forth in any of SEQ ID NOs: 137, 162, 166, 538, 571, 143, 172 or 678.

58. The TCR or antigen-binding fragment thereof of any of embodiments 47-56, wherein the Vβ region comprises:
a complementarity determining region 1 (CDR-1) comprising the amino acid sequence set forth in any of SEQ ID NOs: 484, 148, 546, 561, 579, 168, 668 or 154; and/or
a complementarity determining region 2 (CDR-2) comprising the amino acid sequence set forth in any of SEQ ID NOs: 485, 149, 547, 562, 580, 169, 669 or 155.

59. The TCR or antigen-binding fragment thereof of any of embodiments 47-58, wherein:
the Vα region comprises a CDR-1, CDR-2, and CDR-3, comprising the amino acid sequences of SEQ ID NOs: 136, 137 and 478, respectively, and the Vβ region comprises a CDR-1, CDR-2, and CDR-3, comprising the amino acid sequences of SEQ ID NOs: 484, 485 and 486, respectively;
the Vα region comprises a CDR-1, CDR-2, and CDR-3, comprising the amino acid sequences of SEQ ID NOs: 161, 162 and 493, respectively, and the Vβ region comprises a CDR-1, CDR-2, and CDR-3, comprising the amino acid sequences of SEQ ID NOs: 148, 149 and 499, respectively;
the Vα region comprises a CDR-1, CDR-2, and CDR-3, comprising the amino acid sequences of SEQ ID NOs: 165, 166 and 505, respectively, and the Vβ region comprises a CDR-1, CDR-2, and CDR-3, comprising the amino acid sequences of SEQ ID NOs: 148, 149 and 499, respectively;
the Vα region comprises a CDR-1, CDR-2, and CDR-3, comprising the amino acid sequences of SEQ ID NOs: 161, 162 and 511, respectively, and the Vβ region comprises a CDR-1, CDR-2, and CDR-3, comprising the amino acid sequences of SEQ ID NOs: 148, 149 and 517, respectively;

the Vα region comprises a CDR-1, CDR-2, and CDR-3, comprising the amino acid sequences of SEQ ID NOs: 136, 137 and 523, respectively, and the Vβ region comprises a CDR-1, CDR-2, and CDR-3, comprising the amino acid sequences of SEQ ID NOs: 148, 149 and 531, respectively;

the Vα region comprises a CDR-1, CDR-2, and CDR-3, comprising the amino acid sequences of SEQ ID NOs: 537, 538, and 539, respectively, and the Vβ region comprises a CDR-1, CDR-2, and CDR-3, comprising the amino acid sequences of SEQ ID NOs: 546, 547 and 548, respectively;

the Vα region comprises a CDR-1, CDR-2, and CDR-3, comprising the amino acid sequences of SEQ ID NOs: 136, 137 and 555, respectively, and the Vβ region comprises a CDR-1, CDR-2, and CDR-3, comprising the amino acid sequences of SEQ ID NOs: 561, 562 and 563, respectively;

the Vα region comprises a CDR-1, CDR-2, and CDR-3, comprising the amino acid sequences of SEQ ID NOs: 570, 571 and 572, respectively, and the Vβ region comprises a CDR-1, CDR-2, and CDR-3, comprising the amino acid sequences of SEQ ID NOs: 579, 580 and 581, respectively;

the Vα region comprises a CDR-1, CDR-2, and CDR-3, comprising the amino acid sequences of SEQ ID NOs: 136, 137 and 600, respectively, and the Vβ region comprises a CDR-1, CDR-2, and CDR-3, comprising the amino acid sequences of SEQ ID NOs: 148, 149 and 594, respectively;

the Vα region comprises a CDR-1, CDR-2, and CDR-3, comprising the amino acid sequences of SEQ ID NOs: 136, 137 and 600, respectively, and the Vβ region comprises a CDR-1, CDR-2, and CDR-3, comprising the amino acid sequences of SEQ ID NOs: 148, 149 and 606, respectively;

the Vα region comprises a CDR-1, CDR-2, and CDR-3, comprising the amino acid sequences of SEQ ID NOs: 136, 137 and 612, respectively, and the Vβ region comprises a CDR-1, CDR-2, and CDR-3, comprising the amino acid sequences of SEQ ID NOs: 148, 149 and 618, respectively;

the Vα region comprises a CDR-1, CDR-2, and CDR-3, comprising the amino acid sequences of SEQ ID NOs: 136, 137 and 624, respectively, and the Vβ region comprises a CDR-1, CDR-2, and CDR-3, comprising the amino acid sequences of SEQ ID NOs: 168, 169 and 630, respectively;

the Vα region comprises a CDR-1, CDR-2, and CDR-3, comprising the amino acid sequences of SEQ ID NOs: 142, 143 and 638, respectively, and the Vβ region comprises a CDR-1, CDR-2, and CDR-3, comprising the amino acid sequences of SEQ ID NOs: 561, 562 and 644, respectively;

the Vα region comprises a CDR-1, CDR-2, and CDR-3, comprising the amino acid sequences of SEQ ID NOs: 171, 172 and 650, respectively, and the Vβ region comprises a CDR-1, CDR-2, and CDR-3, comprising the amino acid sequences of SEQ ID NOs: 148, 149 and 656, respectively;

the Vα region comprises a CDR-1, CDR-2, and CDR-3, comprising the amino acid sequences of SEQ ID NOs: 136, 137 and 662, respectively, and the Vβ region comprises a CDR-1, CDR-2, and CDR-3, comprising the amino acid sequences of SEQ ID NOs: 668, 669 and 670, respectively; or the Vα region comprises a CDR-1, CDR-2, and CDR-3, comprising the amino acid sequences of SEQ ID NOs: 677, 678 and 679, respectively, and the Vβ region comprises a CDR-1, CDR-2, and CDR-3, comprising the amino acid sequences of SEQ ID NOs: 154, 155 and 686, respectively.

60. The TCR or antigen-binding fragment thereof of any of embodiments 47-59, wherein:
the Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 477, 492, 504, 510, 522, 536, 554, 569, 587, 599, 611, 623, 637, 649, 661 or 676; and/or
the Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 483, 498, 516, 530, 545, 560, 578, 593, 605, 617, 629, 643, 655, 667 or 685.

61. The TCR or antigen-binding fragment thereof of any of embodiments 47-60, wherein: the Vα and Vβ regions comprise the amino acid sequences of SEQ ID NOs: 477 and 483, respectively; the Vα and Vβ regions comprise the amino acid sequences of SEQ ID NOs: 492 and 498, respectively; the Vα and Vβ regions comprise the amino acid sequences of SEQ ID NOs: 504 and 498, respectively; the Vα and Vβ regions comprise the amino acid sequences of SEQ ID NOs: 510 and 516, respectively; the Vα and Vβ regions comprise the amino acid sequences of SEQ ID NOs: 522 and 530, respectively; the Vα and Vβ regions comprise the amino acid sequences of SEQ ID NOs: 536 and 545, respectively; the Vα and Vβ regions comprise the amino acid sequences of SEQ ID NOs: 554 and 560, respectively; the Vα and Vβ regions comprise the amino acid sequences of SEQ ID NOs: 569 and 578, respectively; the Vα and Vβ regions comprise the amino acid sequences of SEQ ID NOs: 587 and 593, respectively; the Vα and Vβ regions comprise the amino acid sequences of SEQ ID NOs: 599 and 605, respectively; the Vα and Vβ regions comprise the amino acid sequences of SEQ ID NOs: 611 and 617, respectively; the Vα and Vβ regions comprise the amino acid sequences of SEQ ID NOs: 623 and 629, respectively; the Vα and Vβ regions comprise the amino acid sequences of SEQ ID NOs: 637 and 643, respectively; the Vα and Vβ regions comprise the amino acid sequences of SEQ ID NOs: 649 and 655, respectively; the Vα and Vβ regions comprise the amino acid sequences of SEQ ID NOs: 661 and 667, respectively; the Vα and Vβ regions comprise the amino acid sequences of SEQ ID NOs: 676 and 685, respectively.

62. The TCR or antigen-binding fragment thereof of any of embodiments 47-61, wherein the alpha chain further comprises an alpha constant (Cα) region and/or the beta chain further comprises a beta constant (Cβ) region.

63. The TCR or antigen-binding fragment thereof of embodiment 62, wherein the Cα and Cβ regions are mouse constant regions.

64. The TCR or antigen-binding fragment thereof of embodiment 62 or embodiment 63, wherein:

the Cα region comprises the amino acid sequence set forth in SEQ ID NO: 262, 833, 1012, 1014, 1015, 1017, 1018, or a sequence of amino acids that has at least 90% sequence identity thereto; and/or the Cβ region comprises the amino acid sequence set forth in SEQ ID NO: 263, 1013 or 1016 or a sequence of amino acids that has at least 90% sequence identity thereto.

65. The TCR or antigen-binding fragment thereof of embodiment 62, wherein the Cα and Cβ regions are human constant regions.

66. The TCR or antigen-binding fragment thereof of embodiment 62 or embodiment 65, wherein:

the Cα region comprises the amino acid sequence set forth in any of SEQ ID NOs: 212, 213, 215, 217, 218, 220 or 524, or a sequence of amino acids that has at least 90% sequence identity thereto; and/or the Cβ region comprises the amino acid sequence set forth in any of SEQ ID NOs: 214, 216, 631 or 889, or a sequence of amino acids that has at least 90% sequence identity thereto.

67. The TCR or antigen-binding fragment thereof of any of embodiments 47-66, wherein:
a) the alpha chain comprises:
the amino acid sequence set forth in any of SEQ ID NOs: 473, 488, 500, 506, 518, 532, 550, 565, 583, 595, 607, 619, 633, 645, 657 or 672, a sequence of amino acids that has at least 90% sequence identity thereto; or the amino acid sequence encoded by the nucleotide sequence set forth in any of SEQ ID NOs: 389, 430, 1019, 1021, 1023, 1025, 1027, 1029, 1031, 1033, 1035, 1037, 1039, 1041, 1043 or 1045, or a nucleotide sequence that has at least 90% sequence identity thereto; and/or
b) the beta chain comprises:
the amino acid sequence set forth in any of SEQ ID NOs: 479, 494, 512, 526, 541, 556, 574, 589, 601, 613, 625, 639, 651, 663 or 681, a sequence of amino acids that has at least 90% sequence identity thereto; or the amino acid sequence encoded by the nucleotide sequence set forth in SEQ ID NOS: 390, 431, 1020, 1022, 1024, 1026, 1028, 1030, 1032, 1034, 1036, 1038, 1040, 1042, 1044 or 1046, or a nucleotide sequence that has at least 90% sequence identity thereto.

68. The TCR or antigen-binding fragment thereof of any of embodiments 47-67, wherein: the alpha and beta chains comprise the amino acid sequences of SEQ ID NOs: 473 and 479, respectively; the alpha and beta chains comprise the amino acid sequences of SEQ ID NOs: 488 and 494, respectively; the alpha and beta chains comprise the amino acid sequences of SEQ ID NOs: 500 and 494, respectively; the alpha and beta chains comprise the amino acid sequences of SEQ ID NOs: 506 and 512, respectively; the alpha and beta chains comprise the amino acid sequences of SEQ ID NOs: 518 and 526, respectively; the alpha and beta chains comprise the amino acid sequences of SEQ ID NOs: 532 and 541, respectively; the alpha and beta chains comprise the amino acid sequences of SEQ ID NOs: 550 and 556, respectively; the alpha and beta chains comprise the amino acid sequences of SEQ ID NOs: 565 and 574, respectively; the alpha and beta chains comprise the amino acid sequences of SEQ ID NOs: 583 and 589, respectively; the alpha and beta chains comprise the amino acid sequences of SEQ ID NOs: 595 and 601, respectively; the alpha and beta chains comprise the amino acid sequences of SEQ ID NOs: 607 and 613, respectively; the alpha and beta chains comprise the amino acid sequences of SEQ ID NOs: 619 and 625, respectively; the alpha and beta chains comprise the amino acid sequences of SEQ ID NOs: 633 and 639, respectively; the alpha and beta chains comprise the amino acid sequences of SEQ ID NOs: 645 and 651, respectively; the alpha and beta chains comprise the amino acid sequences of SEQ ID NOs: 657 and 663, respectively; or the alpha and beta chains comprise the amino acid sequences of SEQ ID NOs: 672 and 681, respectively.

69. The TCR or antigen-binding fragment thereof of any of embodiments 47-68, wherein the TCR or antigen-binding fragment comprises one or more modifications in the α chain and/or β chain such that when the TCR or antigen-binding fragment thereof is expressed in a cell, the frequency of mispairing between the TCR α chain and β chain and an endogenous TCR α chain and β chain is reduced, the expression of the TCR α chain and β chain is increased and/or the stability of the TCR α chain and β chain is increased, each compared to expression in a cell of the TCR or antigen-binding fragment thereof not containing the one or more modifications.

70. The TCR or antigen-binding fragment thereof of embodiment 69, wherein the one or more modifications is a replacement, deletion, or insertion of one or more amino acids in the Cα region and/or the Cβ region.

71. The TCR or antigen-binding fragment thereof of embodiment 69 or embodiment 70, wherein the one or more modifications comprise replacement(s) to introduce one or more cysteine residues that are capable of forming one or more non-native disulfide bridges between the alpha chain and beta chain.

72. The TCR or antigen-binding fragment thereof of any of embodiments 47-62, 65 and 69-71, comprising a Cα region comprising a cysteine at a position corresponding to position 48 with numbering as set forth in SEQ ID NO: 212, 213, 217, 218, or 524 or at a position corresponding to position 49 with numbering as set forth in SEQ ID NO: 215 or 220; and/or a Cβ region comprising a cysteine at a position corresponding to position 57 with numbering as set forth in SEQ ID NO: 214 or 216 or at a position corresponding to position 58 with numbering as set forth in SEQ ID NO: 631 or 889.

73. The TCR or antigen-binding fragment thereof of any of embodiments 62, 65, and 69-72, wherein:

the Cα region comprises the amino acid sequence set forth in any of SEQ ID NOs: 196, 198, 200, 201, 203, or 525, or a sequence of amino acids that has at least 90% sequence identity thereto comprising one or more cysteine residues capable of forming a non-native disulfide bond with the beta chain; and/or the Cβ region comprises the amino acid sequence set forth in any of SEQ ID NOs: 197,199, 632, or 890 or a sequence of amino acids that has at least 90% sequence identity thereto that contains one or more cysteine residues capable of forming a non-native disulfide bond with the alpha chain.

74. The TCR or antigen-binding fragment thereof of any of embodiments 47-73, wherein the TCR or antigen-binding fragment thereof is encoded by a nucleotide sequence that has been codon-optimized.

75. The TCR or antigen-binding fragment thereof of any of embodiments 47-62, 65, and 69-74, wherein:

a) the alpha chain comprises:

the amino acid sequence set forth in any of SEQ ID NOs: 474, 489, 501, 507, 519, 533, 551, 566, 584, 596, 608, 620, 634, 646, 658 or 673, a sequence of amino acids that has at least 90% sequence identity thereto; or the amino acid sequence encoded by the nucleotide sequence set forth in any of SEQ ID NOs: 1097, 1099, 1101, 1103, 1105, 1107, 1109, 1111, 1113, 1115, 1117, 1119, 1121, 1123, 1125 or 1127, or a nucleotide sequence that has at least 90% sequence identity thereto; and/or b) the beta chain comprises:

the amino acid sequence set forth in any of SEQ ID NOs: 480, 495, 513, 527, 542, 557, 575, 590, 602, 614, 626, 640, 652, 664 or 682, a sequence of amino acids that has at least 90% sequence identity thereto; or the amino acid sequence encoded by the nucleotide sequence set forth in SEQ ID NOS: 1098, 1100, 1102, 1104, 1106, 1108, 1110, 1112, 1114, 1116, 1118, 1120, 1122, 1124, 1126 or 1128, or a nucleotide sequence that has at least 90% sequence identity thereto.

76. The TCR or antigen-binding fragment thereof of any of embodiments 47-62, 65, and 69-75, wherein the alpha and beta chains comprise the amino acid sequences of SEQ ID NOs: 474 and 482, respectively; the alpha and beta chains comprise the amino acid sequences of SEQ ID NOs: 489 and 497, respectively; the alpha and beta chains comprise the amino acid sequences of SEQ ID NOs: 501 and 497, respectively; the alpha and beta chains comprise the amino acid sequences of SEQ ID NOs: 507 and 515, respectively; the alpha and beta chains comprise the amino acid sequences of SEQ ID NOs: 519 and 529, respectively; the alpha and beta chains comprise the amino acid sequences of SEQ ID NOs: 533 and 544, respectively; the alpha and beta chains comprise the amino acid sequences of SEQ ID NOs: 551 and 559, respectively; the alpha and beta chains comprise the amino acid sequences of SEQ ID NOs: 566 and 577, respectively; the alpha and beta chains comprise the amino acid sequences of SEQ ID NOs: 584 and 592, respectively; the alpha and beta chains comprise the amino acid sequences of SEQ ID NOs: 596 and 604, respectively; the alpha and beta chains comprise the amino acid sequences of SEQ ID NOs: 608 and 616, respectively; the alpha and beta chains comprise the amino acid sequences of SEQ ID NOs: 620 and 628, respectively; the alpha and beta chains comprise the amino acid sequences of SEQ ID NOs: 634 and 642, respectively; the alpha and beta chains comprise the amino acid sequences of SEQ ID NOs: 646 and 654, respectively; the alpha and beta chains comprise the amino acid sequences of SEQ ID NOs: 658 and 666, respectively; or the alpha and beta chains comprise the amino acid sequences of SEQ ID NOs: 673 and 684, respectively.

77. The TCR or antigen-binding fragment thereof of any of embodiments 47-76, wherein the alpha and/or beta chain further comprises a signal peptide.

78. The TCR or antigen-binding fragment thereof of embodiment 77, wherein:
the alpha chain comprises the signal peptide comprising the amino acid sequence set forth in any of SEQ ID NOs: 181, 184, 187, 189, 190, 192, 193, 310, 311; and/or
the beta chain comprises the signal peptide comprising the amino acid sequence set forth in any of SEQ ID NOs: 182, 185, 186, 188, 191, or 194.

79. The TCR or antigen-binding fragment thereof of any of embodiments 47-78, that is isolated or purified or is recombinant.

80. The TCR or antigen-binding fragment thereof of any of embodiments 47-79, that is human.

81. The TCR or antigen-binding fragment thereof of any of embodiments 47-80, that is monoclonal.

82. The TCR or antigen-binding fragment thereof of any of embodiments 47-81, wherein the TCR or antigen-binding fragment thereof is single chain.

83. The TCR or antigen-binding fragment thereof of any of embodiments 47-81, wherein the TCR or antigen-binding fragment thereof comprises two chains.

84. The TCR or antigen-binding fragment thereof of any of embodiments 47-83, wherein the antigen-specificity is at least partially CD8-independent.

85. The TCR or antigen-binding fragment of any of embodiments 47-84 wherein the MHC molecule is an HLA-A2 molecule.

86. A nucleic acid molecule encoding the TCR or antigen-binding fragment thereof of any of embodiments 47-85, or an alpha or beta chain thereof.

87. The nucleic acid molecule of embodiment 86, comprising a nucleotide sequence encoding an alpha chain and/or a nucleotide sequence encoding a beta chain, wherein:
the nucleotide sequence encoding an alpha chain comprises the sequence set forth in any of SEQ ID NOS: 389, 430, 1019, 1021, 1023, 1025, 1027, 1029, 1031, 1033, 1035, 1037, 1039, 1041, 1043 or 1045, or a nucleotide sequence that has at least 90% sequence identity thereto;
the nucleotide sequence encoding a beta chain comprises the sequence set forth in SEQ ID NOS: 390, 431, 1020, 1022, 1024, 1026, 1028, 1030, 1032, 1034, 1036, 1038, 1040, 1042, 1044 or 1046, or a nucleotide sequence that has at least 90% sequence identity thereto.

88. The nucleic acid molecule of embodiment 86, wherein the nucleotide sequence is codon-optimized.

89. The nucleic acid molecule of embodiment 86 or embodiment 88, comprising a nucleotide sequence encoding an alpha chain and/or a nucleotide sequence encoding a beta chain, wherein:
the nucleotide sequence encoding an alpha chain comprises the sequence to set forth in any of SEQ ID NOS: 1097, 1099, 1101, 1103, 1105, 1107, 1109, 1111, 1113, 1115, 1117, 1119, 1121, 1123, 1125 or 1127, or a nucleotide sequence that has at least 90% sequence identity thereto;
the nucleotide sequence encoding a beta chain comprises the sequence set forth in SEQ ID NOS: 1098, 1100, 1102, 1104, 1106, 1108, 1110, 1112, 1114, 1116, 1118, 1120, 1122, 1124, 1126 or 1128, or a nucleotide sequence that has at least 90% sequence identity thereto.

90. The nucleic acid molecule of any of embodiments 86-89, wherein the nucleotide sequence encoding the alpha chain and the nucleotide sequence encoding the beta chain are separated by a peptide sequence that causes ribosome skipping.

91. The nucleic acid molecule of embodiment 90, wherein the peptide that causes ribosome skipping is a P2A or T2A peptide and/or comprises the sequence of amino acids set forth in SEQ ID NO: 204 or 211.

92. The nucleic acid molecule of any of embodiments 86-91, comprising the nucleotide sequence set forth in any of SEQ ID NOs: 432, 433, 434, 435, 436, 437, 438, 439, 440, 441, 442, 443, 444, 445, 446 or 447, or a nucleotide sequence having at least 90% sequence identity thereto.

93. The nucleic acid molecule of any of embodiments 40-46 and 86-92, wherein the nucleic acid molecule is synthetic.

94. The nucleic acid molecule of any of embodiments 40-46 and 86-93, wherein the nucleic acid molecule is cDNA.

95. A polynucleotide, comprising:
(a) a nucleic acid sequence encoding the TCR or an antigen-binding portion thereof of any of embodiments 1-39 and 47-85, or the nucleic acid molecule of any of embodiments 40-46 and 86-94, and
(b) one or more homology arm(s) linked to the nucleic acid sequence, wherein the one or more homology arms comprise a sequence homologous to one or more region(s) of an open reading frame of a T cell receptor alpha constant (TRAC) locus.

96. A polynucleotide, comprising:
(a) a nucleic acid sequence encoding a portion of a T cell receptor (TCR), said nucleic acid sequence encoding (i) a T cell receptor beta (TCRβ) chain comprising a variable beta (Vβ) of the TCR or antigen-binding fragment thereof of any of embodiments 1-14, 21-23, 28-39, 47-61, 67-69 and 74-85 and a constant beta (Cβ); and (ii) a portion of a T cell receptor alpha (TCRα) chain comprising a variable alpha (Vα) of the TCR or antigen-binding fragment thereof of any of embodiments 1-14, 21-23, 28-39, 47-61, 67-69 and 74-85, wherein the portion of the TCRα chain is less than a full-length TCRα chain, and
(b) one or more homology arm(s) linked to the nucleic acid sequence, wherein the one or more homology arms comprise a sequence homologous to one or more region(s) of an open reading frame of a T cell receptor alpha constant (TRAC) locus.

97. The polynucleotide of embodiment 96, wherein the TCRα chain comprises a constant alpha (Cα), wherein at least a portion of said Cα is encoded by the open reading frame of the endogenous TRAC locus or a partial sequence thereof when the TCR or antigen-binding fragment thereof is expressed from a cell introduced with the polynucleotide.

98. The polynucleotide of embodiment 96 or embodiment 97, wherein the nucleic acid sequence of (a) and the one of the one or more homology arms together comprise a sequence of nucleotides encoding the Cα that is less than the full length of a native Cα, wherein at least a portion of the Cα is encoded by the open reading frame of the endogenous TRAC locus or a partial sequence thereof when the TCR or antigen-binding fragment thereof is expressed from a cell introduced with the polynucleotide.

99. The polynucleotide of any of embodiments 96-98, wherein the nucleic acid sequence encoding the TCRβ chain is upstream of the nucleic acid sequence encoding the portion of the TCRα chain.

100. The polynucleotide of any of embodiments 96-99, wherein the nucleic acid sequence of (a) does not comprise an intron.

101. The polynucleotide of any of embodiments 96-100, wherein the nucleic acid sequence of (a) is a sequence that is exogenous or heterologous to an open reading frame of an endogenous genomic TRAC locus of a T cell, optionally a human T cell.

102. The polynucleotide of any of embodiments 96-101, wherein the nucleic acid sequence of (a) is in-frame with one or more exons or a partial sequence thereof, optionally exon 1 or a partial sequence thereof, of the open reading frame of the TRAC locus comprised in the one or more homology arm(s).

103. The polynucleotide of any of embodiments 97-102, wherein a portion of the Cα is encoded by the open reading frame of the endogenous TRAC locus or a partial sequence thereof, and a further portion of the Cα is encoded by the nucleic acid sequence of (a), wherein said further portion of Cα is less than the full length of a native Cα.

104. The polynucleotide of embodiment 103, wherein the further portion of the Cα is encoded by a sequence of nucleotides starting from residue 3 and up to residue 3155 of the sequence set forth in SEQ ID NO:348 or one or more exons thereof or a sequence that exhibits at least 85%, 86%, 87%, 88%, 89%, 90%, 91%, 92%, 93%, 94%, 95%, 96%, 97%, 98%, 99% or more sequence identity to a sequence of nucleotides starting from residue 3 and up to residue 3155 of the sequence set forth in SEQ ID NO:348 or one or more exons thereof, or a partial sequence thereof.

105. The polynucleotide of embodiment 103 or embodiment 104, wherein the further portion of the Cα is encoded by a sequence set forth in SEQ ID NO:1364, or a sequence that exhibits at least 85%, 86%, 87%, 88%, 89%, 90%, 91%, 92%, 93%, 94%, 95%, 96%, 97%, 98%, 99% or more sequence identity to SEQ ID NO:1364, or a partial sequence thereof.

106. The polynucleotide of any of embodiments 103-105, wherein the further portion of the Cα and/or the Cβ region encoded by the nucleic acid sequence of (a) comprises one or more modifications, optionally a replacement, deletion, or insertion of one or more amino acids compared to a native Cα region and/or a native Cβ region, optionally said one or more modifications introduces one or more cysteine residues that are capable of forming one or more non-native disulfide bridges between the alpha chain and beta chain.

107. The polynucleotide of any of embodiments 95-106, wherein the one or more homology arm comprises a 5' homology arm and/or a 3' homology arm.

108. The polynucleotide of any of embodiments 95-107, wherein the 5' homology arm comprises:
a) a sequence comprising at or at least at or at least 150, 200, 250, 300, 350, 400, 450, 500, 550, or 600 contiguous nucleotides of a sequence that exhibits at least 85%, 86%, 87%, 88%, 89%, 90%, 91%, 92%, 93%, 94%, 95%, 96%, 97%, 98%, 99% or more sequence identity to the sequence set forth in SEQ ID NO: 1343;
b) a sequence comprising at or at least at or at least 150, 200, 250, 300, 350, 400, 450, 500, 550, or 600 contiguous nucleotides of the sequence set forth in SEQ ID NO: 1343; or
c) the sequence set forth in SEQ ID NO: 1343.

109. The polynucleotide of any of embodiments 95-108, wherein the 3' homology arm comprises:
a) a sequence comprising at or at least at or at least 150, 200, 250, 300, 350, 400, 450, 500, 550, or 600 contiguous nucleotides of a sequence that exhibits at least 85%, 86%, 87%, 88%, 89%, 90%, 91%, 92%, 93%, 94%, 95%, 96%, 97%, 98%, 99% or more sequence identity to the sequence set forth in SEQ ID NO: 1344;

b) a sequence comprising at or at least at or at least 150, 200, 250, 300, 350, 400, 450, 500, 550, or 600 contiguous nucleotides of the sequence set forth in SEQ ID NO: 1344; or c) the sequence set forth in SEQ ID NO: 1344.

110. A polynucleotide, comprising:

(a) a nucleic acid sequence encoding the TCR or an antigen-binding portion thereof of any of embodiments 1-39 and 47-86, or the nucleic acid molecule of any of embodiments 40-46 and 86-92, and (b) one or more homology arm(s) linked to the nucleic acid sequence, wherein the one or more homology arms comprise a sequence homologous to one or more region(s) of an open reading frame of a T cell receptor beta constant (TRBC) locus.

111. A polynucleotide, comprising:

(a) a nucleic acid sequence encoding a portion of a T cell receptor (TCR), said nucleic acid sequence encoding (i) a T cell receptor alpha (TCRα) chain comprising a variable alpha (Vα) of the TCR or antigen-binding fragment thereof of any of embodiments 1-14, 21-23, 28-39, 47-61, 67-69 and 74-85, and a constant alpha (Cα); and (ii) a portion of a T cell receptor beta (TCRβ) chain comprising a variable beta (Vβ) of the TCR or antigen-binding fragment thereof of any of embodiments 1-14, 21-23, 28-39, 47-61, 67-69 and 74-85, wherein the portion of the TCRβ chain is less than a full-length TCRβ chain, and (b) one or more homology arm(s) linked to the nucleic acid sequence, wherein the one or more homology arms comprise a sequence homologous to one or more region(s) of an open reading frame of a T cell receptor beta constant (TRBC) locus.

112. The polynucleotide of embodiment 111, wherein the TCRβ chain comprises a constant beta (Cβ), wherein at least a portion of said Cβ is encoded by the open reading frame of the endogenous TRBC locus or a partial sequence thereof, when the TCR or antigen-binding fragment thereof is expressed from a cell introduced with the polynucleotide.

113. The polynucleotide of embodiment 111 or embodiment 112, wherein the nucleic acid sequence of (a) and the one of the one or more homology arms together comprise a sequence of nucleotides encoding the Cβ that is less than the full length of a native C13, wherein at least a portion of the Cβ is encoded by the open reading frame of the endogenous TRAC locus or a partial sequence thereof when the TCR or antigen-binding fragment thereof is expressed from a cell introduced with the polynucleotide.

114. The polynucleotide of any of embodiments 111-113, wherein the nucleic acid sequence encoding the TCRα chain is upstream of the nucleic acid sequence encoding the portion of the TCRβ chain.

115. The polynucleotide of any of embodiments 111-114, wherein the nucleic acid sequence of (a) does not comprise an intron.

116. The polynucleotide of any of embodiments 111-115, wherein the nucleic acid sequence of (a) is a sequence that is exogenous or heterologous to an open reading frame of an endogenous genomic TRBC locus of a T cell, optionally a human T cell.

117. The polynucleotide of any of embodiments 111-116, wherein the nucleic acid sequence of (a) is in-frame with one or more exons or a partial sequence thereof, optionally exon 1 or a partial sequence thereof, of the open reading frame of the TRBC locus comprised in the one or more homology arm(s).

118. The polynucleotide of any of embodiments 111-117, wherein a portion of the Cβ is encoded by the open reading frame of the endogenous TRBC locus or a partial sequence thereof, and a further portion of the Cβ is encoded by the nucleic acid sequence of (a), wherein said further portion of Cβ is less than the full length of a native C13.

119. The polynucleotide of embodiment 118, wherein the further portion of the Cβ is encoded by:

a sequence of nucleotides starting from residue 3 and up to residue 1445 of the sequence set forth in SEQ ID NO:349 or one or more exons thereof or a sequence that exhibits at least 85%, 86%, 87%, 88%, 89%, 90%, 91%, 92%, 93%, 94%, 95%, 96%, 97%, 98%, 99% or more sequence identity to a sequence of nucleotides starting from residue 3 and up to residue 1445 of the sequence set forth in SEQ ID NO:349 or one or more exons thereof, or a partial sequence thereof; or a sequence of nucleotides starting from residue 3 and up to residue 1486 of the sequence set forth in SEQ ID NO:1047 or one or more exons thereof or a sequence that exhibits at least 85%, 86%, 87%, 88%, 89%, 90%, 91%, 92%, 93%, 94%, 95%, 96%, 97%, 98%, 99% or more sequence identity to a sequence of nucleotides starting from residue 3 and up to residue 1486 of the sequence set forth in SEQ ID NO:1047 or one or more exons thereof, or a partial sequence thereof;

120. The polynucleotide of embodiment 118 or embodiment 119, wherein the further portion of the Cβ and/or the Cα region encoded by the nucleic acid sequence of (a) comprises one or more modifications, optionally a replacement, deletion, or insertion of one or more amino acids compared to a native Cβ region and/or a native Cα region, optionally said one or more modifications introduces one or more cysteine residues that are capable of forming one or more non-native disulfide bridges between the alpha chain and beta chain.

121. The polynucleotide of any of embodiments 110-120, wherein the one or more homology arm comprises a 5' homology arm and/or a 3' homology arm.

122. The polynucleotide of any of embodiments 95-121, wherein the nucleic acid sequence of (a) comprises one or more multicistronic element(s).

123. The polynucleotide of embodiment 122, wherein the multicistronic element(s) is positioned between the nucleic acid sequence encoding the TCRα or a portion thereof and the nucleic acid sequence encoding the TCRβ or a portion thereof.

124. The polynucleotide of embodiment 122 or embodiment 123, wherein the one or more multicistronic element(s) are upstream of the nucleic acid sequence encoding the TCR or a portion of the TCR or the nucleic acid molecule encoding the TCR.

125. The polynucleotide of any of embodiments 122-124, wherein the one or more multicistronic element is or comprises a ribosome skip sequence, optionally wherein the ribosome skip sequence is a T2A, a P2A, an E2A, or an F2A element.

126. The polynucleotide of any of embodiments 95-125, wherein the nucleic acid sequence of (a) comprises one or more heterologous or regulatory control element(s) operably linked to control expression of the TCR when expressed from a cell introduced with the polynucleotide.

127. The polynucleotide of embodiment 126, wherein the one or more heterologous regulatory or control element comprises a promoter, an enhancer, an intron, a polyadenylation signal, a Kozak consensus sequence, a splice acceptor sequence and/or a splice donor sequence.

128. The polynucleotide of embodiment 126 or embodiment 127, wherein the heterologous regulatory or control element comprises heterologous promoter, optionally a human elongation factor 1 alpha (EF1α) promoter or an MND promoter or a variant thereof.

129. The polynucleotide of any of embodiments 95-128, that is a linear polynucleotide, optionally a double-stranded polynucleotide or a single-stranded polynucleotide.

130. A vector comprising the nucleic acid molecule of any of embodiments 40-46 and 86-94 or the polynucleotide of any of embodiments 95-129.

131. The vector of embodiment 130, wherein the vector is an expression vector.

132. The vector of embodiment 130 or embodiment 131, wherein the vector is a viral vector.

133. The vector of embodiment 132, wherein the viral vector is a retroviral vector.

134. The vector of embodiment 132 or embodiment 133, wherein the viral vector is a lentiviral vector.

135. The vector of embodiment 134, wherein the lentiviral vector is derived from HIV-1.

137. The vector of embodiment 132, wherein the viral vector is an AAV vector.

138. The vector of embodiment 137, wherein the AAV vector is selected from among AAV1, AAV2, AAV3, AAV4, AAV5, AAV6, AAV7 or AAV8 vector.

139. An engineered cell comprising the nucleic acid molecule of any of embodiments 40-46 and 86-94, the polynucleotide of any of embodiments 95-129, or the vector of any of embodiments 130-138.

140. An engineered cell, comprising the TCR or antigen-binding fragment thereof of any of embodiments 1-39 and 47-85, optionally a recombinant TCR or antigen-binding fragment of any of embodiments 1-39 and 47-85.

141. The engineered cell of embodiment 139 or embodiment 140, comprising a genetic disruption of an endogenous T cell receptor alpha constant (TRAC) gene and/or a T cell receptor beta constant (TRBC) gene.

142. The engineered cell of embodiment 141, wherein the TRBC gene is one or both of a T cell receptor beta constant 1 (TRBC1) or T cell receptor beta constant 2 (TRBC2) gene.

143. The engineered cell of embodiment 141 or embodiment 142, wherein the engineered cell does not contain a contiguous TRAC and/or TRBC gene; does not contain a TRAC and/or TRBC gene; does not contain a functional TRAC and/or TRBC gene; and/or does not express, does not express at a detectable level, or expresses less than 20%, 15%, 10%, 5%, 4%, 3%, 2% or 1% of a wild-type level, gene product of an endogenous TRAC or TRBC.

144. An engineered cell, comprising a TCR or antigen-binding fragment thereof, optionally a recombinant TCR or antigen-binding fragment thereof, wherein:
(1) the cell comprises a genetic disruption of a T cell receptor alpha constant region (TRAC) gene and/or a T cell receptor beta constant region (TRBC) gene and/or does not express, or does not express at a detectable level, or expresses less than 20%, 15%, 10%, 5%, 4%, 3%, 2%, or 1% of a wild-type level, a gene product of an endogenous TRAC or TRBC; and
(2) the TCR or antigen-binding fragment thereof, or the recombinant TCR or antigen-binding fragment thereof, comprises the TCR or antigen-binding fragment thereof of any of embodiments 1-39 and 47-85, optionally a recombinant TCR or antigen-binding fragment of any of embodiments 1-39 and 47-85.

145. An engineered cell, comprising a TCR or antigen-binding fragment thereof, optionally a recombinant TCR or antigen-binding fragment thereof, wherein:
(1) the cell comprises a genetic disruption of a T cell receptor alpha constant region (TRAC) gene and/or a T cell receptor beta constant region (TRBC) gene and/or does not express, or does not express at a detectable level, or expresses less than 20%, 15%, 10%, 5%, 4%, 3%, 2%, or 1% of a wild-type level, a gene product of an endogenous TRAC or TRBC; and
(2) the TCR or antigen-binding fragment thereof, or the recombinant TCR or antigen-binding fragment thereof, comprises:
(a) a variable alpha (Vα) region comprising the amino acid sequence set forth in any of SEQ ID NOs: 117, 119 or 295 or an amino acid sequence that has at least 90%, 91%, 92%, 93%, 94%, 95%, 96%, 97%, 98%, or 99% sequence identity thereto and a variable beta (Vβ) region comprising the amino acid sequence set forth in any of SEQ ID NOs: 118, 120, or 296, or an amino acid sequence that has at least 90%, 91%, 92%, 93%, 94%, 95%, 96%, 97%, 98%, or 99% sequence identity thereto; and/or
(b) a Vα region comprising a complementarity determining region 3 (CDR-3) comprising the amino acid sequence set forth in any of SEQ ID NOs: 153, 159, or 301, or a CDR3 contained within the amino acid sequence set forth in any of SEQ ID NOs: 117, 119, or 295 and a Vβ region comprising a complementarity determining region 3 (CDR-3) comprising an amino acid sequence set forth in any of SEQ ID NOs: 156 or 160 or a CDR3 contained within the amino acid sequence set forth in any of SEQ ID NOs: 118, 120, or 296.

146. The engineered cell embodiment 145, wherein:
the Vα region further comprises a complementarity determining region 1 (CDR-1) comprising an amino acid sequence set forth in any of SEQ ID NOs: 151 or 157; and/or a complementarity determining region 2 (CDR-2) comprising an amino acid sequence set forth in any of SEQ ID NOs: 152 or 158; and/or
the Vβ region comprises further comprises a complementarity determining region 1 (CDR-1) comprising the amino acid sequence set forth in SEQ ID NO: 154; and/or a complementarity determining region 2 (CDR-2) comprising the amino acid sequence set forth in SEQ ID NO: 155.

147. The engineered cell of embodiment 145 or embodiment 146, wherein the Vα region and Vβ region comprise:
a CDR-1, CDR-2, and CDR-3, comprising the amino acid sequences of SEQ ID NOs: 151, 152, and 153, respectively, and the Vβ region comprises a CDR-1, CDR-2, and CDR-3, comprising the amino acid sequences of SEQ ID NOs: 154, 155, and 156, respectively;
a CDR-1, CDR-2, and CDR-3, comprising the amino acid sequences of SEQ ID NOs: 157, 158, and 159, respectively, and the Vβ region comprises a CDR-1, CDR-2, and CDR-3, comprising the amino acid sequences of SEQ ID NOs: 154, 155, and 160, respectively; or a CDR-1, CDR-2, and CDR-3, comprising the amino acid sequences of SEQ ID NOs: 151, 152, and 301, respectively, and the Vβ region comprises a CDR-1, CDR-2, and CDR-3, comprising the amino acid sequences of SEQ ID NOs: 154, 155, and 156, respectively.

148. The engineered cell of any of embodiments 145-147, wherein:

the Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 117, 119, or 295; and/or the Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 118, 120, or 296.

149. The engineered cell of any of embodiments 145-148:

the Vα and Vβ regions comprise the amino acid sequences of SEQ ID NOs: 117 and either 118 or 296, respectively;

the Vα and Vβ regions comprise the amino acid sequences of SEQ ID NOs: 119 and 120, respectively; or the Vα and Vβ regions comprise the amino acid sequences of SEQ ID NOs: 295 and either 118 or 296, respectively.

150. The engineered cell of any of embodiments 145-149, wherein the TCR or antigen-binding fragment thereof binds to or recognizes a peptide epitope of human papillomavirus (HPV) 16 E7 in the context of an MHC molecule, the peptide epitope is or comprises E7(11-19) YMLDLQPET (SEQ ID NO:236).

151. An engineered cell, comprising a TCR or antigen-binding fragment thereof, optionally a recombinant TCR or antigen-binding fragment thereof, wherein:

(1) the cell comprises a genetic disruption of a T cell receptor alpha constant region (TRAC) gene and/or a T cell receptor beta constant region (TRBC) gene and/or does not express, or does not express at a detectable level, or expresses less than 20%, 15%, 10%, 5%, 4%, 3%, 2%, or 1% of a wild-type level, a gene product of an endogenous TRAC or TRBC; and (2) the TCR or antigen-binding fragment thereof, or the recombinant TCR or antigen-binding fragment thereof, comprises:

(a) a variable alpha (Vα) region Vα region comprising the amino acid sequence set forth in any of SEQ ID NOs: 111, 113, 115, 121, 123, 125, 297, or 299 or an amino acid sequence that has at least 90%, 91%, 92%, 93%, 94%, 95%, 96%, 97%, 98%, or 99% sequence identity thereto; and/or a Vβ region comprising the amino acid sequence set forth in any of SEQ ID NOs: SEQ ID NOs: 112, 114, 116, 122, 124, 126, 298, or 300, or an amino acid sequence that has at least 90%, 91%, 92%, 93%, 94%, 95%, 96%, 97%, 98%, or 99% sequence identity thereto; and/or (b) a Vα region comprising a complementarity determining region 3 (CDR-3) comprising the amino acid sequence set forth in any of SEQ ID NOs: 138, 144, 147, 163, 167, 173, 304, or 308, or a CDR3 contained within the amino acid sequence set forth in any of SEQ ID NOs: 111, 113, 115, 121, 123, 125, 297, or 299 and a Vβ region comprising a complementarity determining region 3 (CDR-3) comprising the amino acid sequence set forth in any of SEQ ID NOs: 141, 146, 150, 164, 170, 174, 305, or 309, or a CDR3 contained within the amino acid sequence set forth in any of SEQ ID NOs: 112, 114, 116, 122, 124, 126, 298, or 300.

152. The engineered cell embodiment 151, wherein:

the Vα region further comprises a complementarity determining region 1 (CDR-1) comprising an amino acid sequence set forth in any of SEQ ID NOs: 136, 142, 161, 165, 171, 302, or 306, or a CDR-1 contained within the amino acid sequence set forth in any of SEQ ID NOs: 111, 113, 115, 121, 123, 125, 297, or 299; and/or a complementarity determining region 2 (CDR-2) comprising an amino acid sequence set forth in any of SEQ ID NOs: 137, 143, 162, 166, 172, 303, or 307, or a CDR-2 contained within the amino acid sequence set forth in any of SEQ ID NOs: 111, 113, 115, 121, 123, 125, 297, or 299; and/or the Vβ region comprises further comprises a complementarity determining region 1 (CDR-1) comprising an amino acid sequence set forth in any of SEQ ID NOs: 139, 145, 148, 168, or a CDR-1 contained within the amino acid sequence set forth in any of SEQ ID NOs: 112, 114, 116, 122, 124, 126, 298, or 300; and/or a complementarity determining region 2 (CDR-2) comprising an amino acid sequence set forth in any of SEQ ID NOs: 140, 149, or 169 or a CDR-2 contained within the amino acid sequence set forth in any of SEQ ID NOs: 112, 114, 116, 122, 124, 126, 298, or 300.

153. The engineered cell of embodiment 151 or embodiment 152, wherein:

the Vα region comprises a CDR-1, CDR-2, and CDR-3, comprising the amino acid sequences of SEQ ID NOs: 136, 137, and 138, respectively, and the Vβ region comprises a CDR-1, CDR-2, and CDR-3, comprising the amino acid sequences of SEQ ID NOs: 139, 140, and 141, respectively;

the Vα region comprises a CDR-1, CDR-2, and CDR-3, comprising the amino acid sequences of SEQ ID NOs: 142, 143, and 144, respectively, and the Vβ region comprises a CDR-1, CDR-2, and CDR-3, comprising the amino acid sequences of SEQ ID NOs: 145, 140, and 146, respectively;

the Vα region comprises a CDR-1, CDR-2, and CDR-3, comprising the amino acid sequences of SEQ ID NOs: 136, 137, and 147, respectively, and the Vβ region comprises a CDR-1, CDR-2, and CDR-3, comprising the amino acid sequences of SEQ ID NOs: 148, 149, and 150, respectively;

the Vα region comprises a CDR-1, CDR-2, and CDR-3, comprising the amino acid sequences of SEQ ID NOs: 161, 162, and 163, respectively, and the Vβ region comprises a CDR-1, CDR-2, and CDR-3, comprising the amino acid sequences of SEQ ID NOs: 148, 149, and 164, respectively;

the Vα region comprises a CDR-1, CDR-2, and CDR-3, comprising the amino acid sequences of SEQ ID NOs: 165, 166, and 167, respectively, and the Vβ region comprises a CDR-1, CDR-2, and CDR-3, comprising the amino acid sequences of SEQ ID NOs: 168, 169, and 170, respectively;

the Vα region comprises a CDR-1, CDR-2, and CDR-3, comprising the amino acid sequences of SEQ ID NOs: 171, 172, and 173, respectively, and the Vβ region comprises a CDR-1, CDR-2, and CDR-3, comprising the amino acid sequences of SEQ ID NOs: 148, 149, and 174, respectively;

the Vα region comprises a CDR-1, CDR-2, and CDR-3, comprising the amino acid sequences of SEQ ID NOs: 302, 303, and 304, respectively, and the Vβ region comprises a CDR-1, CDR-2, and CDR-3, comprising the amino acid sequences of SEQ ID NOs: 139, 140, and 305, respectively;

the Vα region comprises a CDR-1, CDR-2, and CDR-3, comprising the amino acid sequences of SEQ ID NOs: 306, 307, and 308, respectively, and the Vβ region comprises a CDR-1, CDR-2, and CDR-3, comprising the amino acid sequences of SEQ ID NOs: 148, 149, and 309, respectively.

154. The engineered cell of any of embodiments 151-153, wherein:

the Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 111, 113, 115, 121, 123, 125, 297, or 299; and/or the Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 112, 114, 116, 122, 124, 126, 298, or 300.

155. The engineered cell of any of embodiments 151-154:
the Vα and Vβ regions comprise the amino acid sequences of SEQ ID NOs: 111 and 112, respectively;
the Vα and Vβ regions comprise the amino acid sequences of SEQ ID NOs: 113 and 114, respectively;
the Vα and Vβ regions comprise the amino acid sequences of SEQ ID NOs: 115 and 116, respectively;
the Vα and Vβ regions comprise the amino acid sequences of SEQ ID NOs: 121 and 122, respectively;
the Vα and Vβ regions comprise the amino acid sequences of SEQ ID NOs: 123 and 124, respectively;
the Vα and Vβ regions comprise the amino acid sequences of SEQ ID NOs: 125 and 126, respectively;
the Vα and Vβ regions comprise the amino acid sequences of SEQ ID NOs: 297 and 298, respectively;
the Vα and Vβ regions comprise the amino acid sequences of SEQ ID NOs: 299 and 300, respectively.

156. The engineered cell of any of embodiments 151-155, wherein the TCR or antigen-binding fragment thereof binds to or recognizes a peptide epitope of human papillomavirus (HPV) 16 E6 in the context of an MHC molecule, the peptide epitope is or comprises E6(29-38) TIHDIILECV (SEQ ID NO:233).

157. The engineered cell of any of embodiments 145-156, wherein the alpha chain further comprises an alpha constant (Cα) region and/or the beta chain further comprises a beta constant (Cβ) region.

158. The engineered cell of any of embodiments 143-157, wherein the gene product is an mRNA or protein encoded by the TRAC or TRBC gene.

159. The engineered cell of any of embodiments 141-158, wherein the genetic disruption comprises a mutation or deletion in a region of the TRAC or TRBC gene that is within a coding region, optionally an early coding region of the gene, is within exon 1 of the gene, is in the coding region within 500, 400, 300, 200, 100, or 50 base pairs of a start codon of the gene, is within a target site sequence that is complementary to the targeting site of a guide RNA (gRNA) targeting domain having a sequence selected from any of SEQ ID NOS:1053 and 1259-1315, and/or to which a targeting domain having a sequence selected from among SEQ ID NOS:1053 and 1259-1315 specifically hybridizes, and/or is within a target site sequence that is complementary to the targeting site of a gRNA targeting domain having a sequence selected from any of SEQ ID NOS: 1048 and 1229-1258, and/or to which a targeting domain having a sequence selected from among SEQ ID NOS: 1048 and 1229-1258 specifically hybridizes.

160. The engineered cell of any of embodiments 141-159, wherein the genetic disruption is effected by one or more agent that comprises (a) a least one gRNA having a targeting domain that is complementary with a target domain of a TRAC gene and/or a TRBC gene or (b) at least one nucleic acid encoding the at least one gRNA.

161. The engineered cell of any of embodiments 141-160, wherein the one or more agent comprises at least one complex of a Cas9 molecule and the at least one gRNA having a targeting domain that is complementary with a target domain of a TRAC gene and/or a TRBC gene.

162. The engineered cell of any of embodiment 160 or embodiment 161, wherein the at least one gRNA comprises a targeting domain that is complementary with a target domain of a TRAC gene, said targeting domain comprising the sequence selected from

UCUCUCAGCUGGUACACGGC, (SEQ ID NO: 1229)

UGGAUUUAGAGUCUCUCAGC, (SEQ ID NO: 1230)

ACACGGCAGGGUCAGGGUUC, (SEQ ID NO: 1231)

GAGAAUCAAAAUCGGUGAAU, (SEQ ID NO: 1048)

GCUGGUACACGGCAGGGUCA, (SEQ ID NO: 1232)

CUCAGCUGGUACACGGC, (SEQ ID NO: 1233)

UGGUACACGGCAGGGUC, (SEQ ID NO: 1234)

GCUAGACAUGAGGUCUA, (SEQ ID NO: 1235)

GUCAGAUUUGUUGCUCC, (SEQ ID NO: 1236)

UCAGCUGGUACACGGCA, (SEQ ID NO: 1237)

GCAGACAGACUUGUCAC, (SEQ ID NO: 1238)

GGUACACGGCAGGGUCA, (SEQ ID NO: 1239)

CUUCAAGAGCAACAGUGCUG, (SEQ ID NO: 1240)

AGAGCAACAGUGCUGUGGCC, (SEQ ID NO: 1241)

AAAGUCAGAUUUGUUGCUCC, (SEQ ID NO: 1242)

-continued

ACAAAACUGUGCUAGACAUG, (SEQ ID NO: 1243)

AAACUGUGCUAGACAUG, (SEQ ID NO: 1244)

UGUGCUAGACAUGAGGUCUA, (SEQ ID NO: 1245)

GGCUGGGGAAGAAGGUGUCUUC, (SEQ ID NO: 1246)

GCUGGGGAAGAAGGUGUCUUC, (SEQ ID NO: 1247)

GGGGAAGAAGGUGUCUUC, (SEQ ID NO: 1248)

GUUUUGUCUGUGAUAUACACAU, (SEQ ID NO: 1249)

GGCAGACAGACUUGUCACUGGAUU, (SEQ ID NO: 1250)

GCAGACAGACUUGUCACUGGAUU, (SEQ ID NO: 1251)

GACAGACUUGUCACUGGAUU, (SEQ ID NO: 1252)

GUGAAUAGGCAGACAGACUUGUCA, (SEQ ID NO: 1253)

GAAUAGGCAGACAGACUUGUCA, (SEQ ID NO: 1254)

GAGUCUCUCAGCUGGUACACGG, (SEQ ID NO: 1255)

GUCUCUCAGCUGGUACACGG, (SEQ ID NO: 1256)

GGUACACGGCAGGGUCAGGGUU, and (SEQ ID NO: 1257)

GUACACGGCAGGGUCAGGGUU. (SEQ ID NO: 1258)

163. The engineered cell of any of embodiments 160-162, wherein the gRNA comprises a targeting domain that is complementary with a target domain of a TRBC gene, optionally in one or both of a TRBC1 and a TRBC2 gene, said targeting domain comprising the sequence selected from

CACCCAGAUCGUCAGCGCCG, (SEQ ID NO: 1259)

CAAACACAGCGACCUCGGGU, (SEQ ID NO: 1260)

UGACGAGUGGACCCAGGAUA, (SEQ ID NO: 1261)

GGCUCUCGGAGAAUGACGAG, (SEQ ID NO: 1262)

GGCCUCGGCGCUGACGAUCU, (SEQ ID NO: 1053)

GAAAAACGUGUUCCCACCCG, (SEQ ID NO: 1263)

AUGACGAGUGGACCCAGGAU, (SEQ ID NO: 1264)

AGUCCAGUUCUACGGGCUCU, (SEQ ID NO: 1265)

CGCUGUCAAGUCCAGUUCUA, (SEQ ID NO: 1266)

AUCGUCAGCGCCGAGGCCUG, (SEQ ID NO: 1267)

UCAAACACAGCGACCUCGGG, (SEQ ID NO: 1268)

CGUAGAACUGGACUUGACAG, (SEQ ID NO: 1269)

AGGCCUCGGCGCUGACGAUC, (SEQ ID NO: 1270)

UGACAGCGGAAGUGGUUGCG, (SEQ ID NO: 1271)

UUGACAGCGGAAGUGGUUGC, (SEQ ID NO: 1272)

UCUCCGAGAGCCCGUAGAAC, (SEQ ID NO: 1273)

CGGGUGGGAACACGUUUUUC, (SEQ ID NO: 1274)

GACAGGUUUGGCCCUAUCCU, (SEQ ID NO: 1275)

GAUCGUCAGCGCCGAGGCCU, (SEQ ID NO: 1276)

GGCUCAAACACAGCGACCUC, (SEQ ID NO: 1277)

UGAGGGUCUCGGCCACCUUC, (SEQ ID NO: 1278)

AGGCUUCUACCCCGACCACG, (SEQ ID NO: 1279)

CCGACCACGUGGAGCUGAGC, (SEQ ID NO: 1280)

UGACAGGUUUGGCCCUAUCC, (SEQ ID NO: 1281)

CUUGACAGCGGAAGUGGUUG, (SEQ ID NO: 1282)

AGAUCGUCAGCGCCGAGGCC, (SEQ ID NO: 1283)

GCGCUGACGAUCUGGGUGAC, (SEQ ID NO: 1284)

UGAGGGCGGGCUGCUCCUUG, (SEQ ID NO: 1285)

GUUGCGGGGGUUCUGCCAGA, (SEQ ID NO: 1286)

AGCUCAGCUCCACGUGGUCG, (SEQ ID NO: 1287)

GCGGCUGCUCAGGCAGUAUC, (SEQ ID NO: 1288)

GCGGGGGUUCUGCCAGAAGG, (SEQ ID NO: 1289)

UGGCUCAAACACAGCGACCU, (SEQ ID NO: 1290)

ACUGGACUUGACAGCGGAAG, (SEQ ID NO: 1291)

GACAGCGGAAGUGGUUGCGG, (SEQ ID NO: 1292)

GCUGUCAAGUCCAGUUCUAC, (SEQ ID NO: 1293)

GUAUCUGGAGUCAUUGAGGG, (SEQ ID NO: 1294)

CUCGGCGCUGACGAUCU, (SEQ ID NO: 1295)

CCUCGGCGCUGACGAUC, (SEQ ID NO: 1296)

CCGAGAGCCCGUAGAAC, (SEQ ID NO: 1297)

CCAGAUCGUCAGCGCCG, (SEQ ID NO: 1298)

GAAUGACGAGUGGACCC, (SEQ ID NO: 1299)

GGGUGACAGGUUUGGCCCUAUC, (SEQ ID NO: 1300)

GGUGACAGGUUUGGCCCUAUC, (SEQ ID NO: 1301)

GUGACAGGUUUGGCCCUAUC, (SEQ ID NO: 1302)

GACAGGUUUGGCCCUAUC, (SEQ ID NO: 1303)

GAUACUGCCUGAGCAGCCGCCU, (SEQ ID NO: 1304)

GACCACGUGGAGCUGAGCUGGUGG, (SEQ ID NO: 1305)

GUGGAGCUGAGCUGGUGG, (SEQ ID NO: 1306)

GGGCGGGCUGCUCCUUGAGGGGCU, (SEQ ID NO: 1307)

GGCGGGCUGCUCCUUGAGGGGCU, (SEQ ID NO: 1308)

GCGGGCUGCUCCUUGAGGGGCU, (SEQ ID NO: 1309)

GGGCUGCUCCUUGAGGGGCU, (SEQ ID NO: 1310)

GGCUGCUCCUUGAGGGGCU, (SEQ ID NO: 1311)

GCUGCUCCUUGAGGGGCU, (SEQ ID NO: 1312)

GGUGAAUGGGAAGGAGGUGCACAG, (SEQ ID NO: 1313)

GUGAAUGGGAAGGAGGUGCACAG, (SEQ ID NO: 1314)
and

GAAUGGGAAGGAGGUGCACAG. (SEQ ID NO: 1315)

164. The engineered cell of any of embodiments 141-163, wherein:
the engineered cell comprises a genetic disruption of a T cell receptor alpha constant (TRAC) gene and a T cell receptor beta constant (TRBC) gene; and/or
the one or more agent comprises an agent comprising at least one gRNA having a targeting domain that is complementary with a target domain of a TRAC gene and an agent comprising at least one gRNA having a target domain that is complementary with a target domain of a TRBC gene, optionally one or both of a TRBC1 gene and a TRBC2 gene.

165. The engineered cell of any of embodiments 159-164, wherein the targeting domain comprises a sequence complementary with a target domain of a TRAC gene and the targeting domain comprises the sequence GAGAAUCAAAAUCGGUGAAU (SEQ ID NO:1048)

166. The engineered cell of any of embodiments 159-165, wherein the targeting domain comprises a sequence complementary with a target domain of a TRBC gene and the targeting domain comprises the sequence GGC-CUCGGCGCUGACGAUCU (SEQ ID NO:1053).

167. The engineered cell of any of embodiments 159-166, wherein the gRNA further comprises a first complementarity domain, a second complementarity domain that is complementary to the first complementarity domain, a proximal domain and optionally a tail domain.

168. The engineered cell of embodiment 167, wherein the first complementarity domain and second complementarity domain are joined by a linking domain.

169. The engineered cell of embodiment 167 or embodiment 168, wherein the guide RNA comprises a 3' poly-A tail and a 5' Anti-Reverse Cap Analog (ARCA) cap.

170. The engineered cell any of embodiments 161-169, wherein the Cas9 molecule is an enzymatically active Cas9.

171. The engineered cell of any of embodiments 161-170, wherein the Cas9 molecule is an S. aureus Cas9 molecule.

172. The engineered cell of any of embodiments 161-171, wherein the Cas9 molecule is an S. pyogenes Cas9.

173. The engineered cell of any of embodiments 141-172, wherein the engineered cell comprises a genetic disruption of a T cell receptor alpha constant (TRAC) locus.

174. The engineered cell of any of embodiments 141-173, wherein the endogenous TRAC locus is further modified by integration of a nucleic acid sequence encoding the TCR or an antigen-binding fragment thereof at the TRAC locus, optionally via HDR.

175. The engineered cell of any of embodiments 141-173, wherein the endogenous TRAC locus is further modified by integration of a transgene sequence encoding a portion of the TCR or an antigen-binding fragment thereof, optionally via homology directed repair (HDR).

176. An engineered cell comprising a modified TRAC locus encoding the TCR or an antigen-binding fragment thereof of any of embodiments 1-39 and 47-85.

177. An engineered cell comprising a modified TRAC locus, wherein the endogenous TRAC locus is modified by integration of a transgene sequence encoding a portion of the TCR, said transgene sequence encoding (i) a T cell receptor beta (TCRβ) chain comprising a variable beta (Vβ) of the TCR or antigen-binding fragment thereof of any of embodiments 1-14, 21-23, 28-39, 47-61, 67-69 and 74-85 and a constant beta (Cβ); and (ii) a portion of a T cell receptor alpha (TCRα) chain comprising a variable alpha (Vα) of the TCR or antigen-binding fragment thereof of any of embodiments 1-14, 21-23, 28-39, 47-61, 67-69 and 74-85, wherein at least a portion of the constant alpha (Cα) of the TCR is encoded by the open reading frame of the endogenous TRAC locus or a partial sequence thereof.
178. The engineered cell of any of embodiments 174-176, wherein the TCR or an antigen-binding fragment thereof comprises a Cα, at least a portion of said Cα is encoded by an open reading frame or a partial sequence thereof of the endogenous TRAC locus.
179. The engineered cell of any of embodiments 174-178, wherein the modified TRAC locus comprises an in-frame fusion of (i) a transgene sequence encoding a portion of the TCR and (ii) an open reading frame or a partial sequence thereof of the endogenous TRAC locus.
180. The engineered cell of any of embodiments 175, 177 and 179, wherein the transgene sequence does not comprise a sequence encoding a 3' UTR or an intron.
181. The engineered cell of any of embodiments 177-180, wherein the open reading frame or a partial sequence thereof comprises a 3' UTR of the endogenous TRAC locus.
182. The engineered cell of any of embodiments 176, 177, and 179-181, wherein the transgene sequence is integrated downstream of the most 5' nucleotide of exon 1 and upstream of the most 3' nucleotide of exon 1 of the open reading frame of the endogenous TRAC locus.
183. The engineered cell of any of embodiments 177-182, wherein the at least a portion of Cα is encoded by at least exons 2-4 of the open reading frame of the endogenous TRAC locus.
184. The engineered cell of any of embodiments 177-183, wherein the at least a portion Cα is encoded by at least a portion of exon 1 and exons 2-4 of the open reading frame of the endogenous TRAC locus.
185. The engineered cell of any of embodiments 175, 177 and 179-184, wherein the transgene sequence encodes a T cell receptor beta (TCRβ) chain and/or a TCR alpha variable region (Vα).
186. The engineered cell of any of embodiments 173-185, further comprising a genetic disruption of a T cell receptor beta constant region (TRBC) locus, optionally a TRBC1 or a TRBC2 locus.
187. The engineered cell of any of embodiments 141-173, wherein the engineered cell comprises a genetic disruption of a T cell receptor beta constant (TRBC) locus.
188. The engineered cell of any of embodiments 141-173, wherein the endogenous TRBC locus is further modified by integration of a nucleic acid sequence encoding the TCR or an antigen-binding fragment thereof at the TRBC locus, optionally via HDR.
189. The engineered cell of any of embodiments 141-173, wherein the endogenous TRBC locus is further modified by integration of a transgene sequence encoding a portion of the TCR or an antigen-binding fragment thereof, optionally via homology directed repair (HDR).
190. An engineered cell comprising a modified TRBC locus encoding the TCR or an antigen-binding fragment thereof of any of embodiments 1-39 and 47-85.
191. An engineered cell comprising a modified TRBC locus, wherein the endogenous TRBC locus is modified by integration of a transgene sequence encoding a portion of the TCR, said transgene sequence encoding (i) a T cell receptor alpha (TCRα) chain comprising a variable alpha (Vα) of the TCR or antigen-binding fragment thereof of any of embodiments 1-14, 21-23, 28-39, 47-61, 67-69 and 74-85 and a constant alpha (Cα); and (ii) a portion of a T cell receptor beta (TCRβ) chain comprising a variable beta (Vβ) of the TCR or antigen-binding fragment thereof of any of embodiments 1-14, 21-23, 28-39, 47-61, 67-69 and 74-85, wherein at least a portion of the constant beta (Cβ) of the TCR is encoded by the open reading frame of the endogenous TRBC locus or a partial sequence thereof.
192. The engineered cell of any of embodiments 188-190, wherein the TCR or an antigen-binding fragment thereof comprises a Cβ, at least a portion of said Cβ is encoded by an open reading frame or a partial sequence thereof of the endogenous TRBC locus.
193. The engineered cell of any of embodiments 188-192, wherein the modified TRBC locus comprises an in-frame fusion of (i) a transgene sequence encoding a portion of the TCR and (ii) an open reading frame or a partial sequence thereof of the endogenous TRBC locus.
194. The engineered cell of any of embodiments 189, 191 and 193, wherein the transgene sequence does not comprise a sequence encoding a 3' UTR or an intron.
195. The engineered cell of any of embodiments 192-194, wherein the open reading frame or a partial sequence thereof comprises a 3' UTR of the endogenous TRBC locus.
196. The engineered cell of any of embodiments 189, 191 and 193-195, wherein the transgene sequence is integrated downstream of the most 5' nucleotide of exon 1 and upstream of the most 3' nucleotide of exon 1 of the open reading frame of the endogenous TRBC locus.
197. The engineered cell of any of embodiments 191-196, wherein the at least a portion of Cβ is encoded by at least exons 2-4 of the open reading frame of the endogenous TRBC locus.
198. The engineered cell of any of embodiments 191-197, wherein the at least a portion of Cβ is encoded by at least a portion of exon 1 and exons 2-4 of the open reading frame of the endogenous TRBC locus.
199. The engineered cell of any of embodiments 189, 191 and 193-198, wherein the transgene sequence encodes a T cell receptor alpha (TCRα) chain and/or a TCR beta variable region (Vβ).
200. The engineered cell of any of embodiments 187-199, wherein TRBC locus is one or both of a T cell receptor beta constant 1 (TRBC1) or T cell receptor beta constant 2 (TRBC2) locus.
201. The engineered cell of any of embodiments 188-200, further comprising a genetic disruption of a T cell receptor alpha constant region (TRAC) locus.
202. The engineered cell of any of embodiments 174-186 and 188-201, wherein the transgene sequence or the nucleic acid sequence encoding the TCR or an antigen-binding fragment thereof comprises one or more multicistronic element(s).
203. The engineered cell of embodiment 202, wherein the one or more multicistronic element(s) are upstream of the transgene sequence or the nucleic acid sequence encoding the TCR or an antigen-binding fragment thereof.
204. The engineered cell of any of embodiments 174-186 and 188-203, wherein the multicistronic element(s) is positioned between the nucleic acid sequence encoding the TCRα or a portion thereof and the nucleic acid sequence encoding the TCRβ or a portion thereof.
205. The engineered cell of any of embodiments 174-186 and 188-204, wherein the one or more multicistronic element is or comprises a ribosome skip sequence, optionally wherein the ribosome skip sequence is a T2A, a P2A, an E2A, or an F2A element.

206. The engineered cell of any of embodiments 174-186 and 188-205, wherein the transgene sequence or the nucleic acid sequence encoding the TCR or an antigen-binding fragment thereof comprises one or more heterologous or regulatory control element(s) operably linked to control expression of the TCR when expressed from a cell introduced with the engineered cell.

207. The engineered cell of embodiment 206, wherein the one or more heterologous regulatory or control element comprises a promoter, an enhancer, an intron, a polyadenylation signal, a Kozak consensus sequence, a splice acceptor sequence and/or a splice donor sequence.

208. The engineered cell of embodiment 206 or embodiment 207, wherein the heterologous regulatory or control element comprises heterologous promoter, optionally a human elongation factor 1 alpha (EF1α) promoter or an MND promoter or a variant thereof.

209. The engineered cell of any of embodiments 139-208, wherein the TCR or antigen-binding fragment thereof or a portion thereof is heterologous to the cell.

210. The engineered cell of any of embodiments 139-209 wherein the engineered cell is a cell line.

211. The engineered cell of any of embodiments 139-210, wherein the engineered cell is a primary cell obtained from a subject.

212. The engineered cell of embodiment 211, wherein the subject is a mammalian subject.

213. The engineered cell of embodiment 211 or embodiment 212, wherein the subject is a human.

214. The engineered cell of any of embodiments 139-214, wherein the engineered cell is a T cell.

215. The engineered cell of embodiment 214, wherein the T cell is CD8+.

216. The engineered cell of embodiment 214, wherein the T cell is CD4+.

217. A method for producing a cell of any of embodiments 139-216, comprising introducing a vector of any of embodiments 130-138 into a cell in vitro or ex vivo.

218. A method for producing a cell, comprising introducing a nucleic acid molecule encoding the TCR or antigen-binding fragment thereof of any of embodiments 1-39 and 47-85, the nucleic acid molecule of any of embodiments 40-46 and 86-94, the polynucleotide of any of embodiments 95-129, or the vector of any of embodiments 130-138 into a cell in vitro or ex vivo.

219. The method of embodiment 217 or embodiment 218, wherein the vector is a viral vector and the introducing is carried out by transduction.

220. The method of any of embodiments 217-219, further comprising introducing into the cell one or more agent, wherein each of the one or more agent is independently capable of inducing a genetic disruption of a T cell receptor alpha constant (TRAC) gene and/or a T cell receptor beta constant (TRBC) gene.

221. A method for producing an engineered cell, comprising:
(i) introducing a nucleic acid molecule encoding the TCR or antigen-binding fragment thereof of any of embodiments 1-39 and 47-85, the nucleic acid molecule of any of embodiments 40-46 and 86-94, the polynucleotide of any of embodiments 95-129, or the vector of vector of any of embodiments 130-138 into a cell; and (ii) introducing into the cell one or more agent wherein each of the one or more agent is independently capable of inducing a genetic disruption of a T cell receptor alpha constant (TRAC) gene and/or a T cell receptor beta constant (TRBC) gene.

222. The method of embodiment 221, wherein the TRBC gene is one or both of a T cell receptor beta constant 1 (TRBC1) or T cell receptor beta constant 2 (TRBC2) gene.

223. The method of any of embodiment 222, wherein the one or more agent capable of inducing a genetic disruption comprises a DNA binding protein or DNA-binding nucleic acid that specifically binds to or hybridizes to the target site.

224. The method of embodiment 223, wherein the one or more agent capable of inducing a genetic disruption comprises (a) a fusion protein comprising a DNA-targeting protein and a nuclease or (b) an RNA-guided nuclease.

225. The method of embodiment 224, wherein the DNA-targeting protein or RNA-guided nuclease comprises a zinc finger protein (ZFP), a TAL protein, or a clustered regularly interspaced short palindromic nucleic acid (CRISPR)-associated nuclease (Cas) specific for a target site within the TRAC and/or TRBC gene.

226. The method of embodiment 225, wherein the one or more agent comprises a zinc finger nuclease (ZFN), a TAL-effector nuclease (TALEN), or and a CRISPR-Cas9 combination that specifically binds to, recognizes, or hybridizes to the target site.

227. The method of embodiment 225 or embodiment 226, wherein the each of the one or more agent comprises a guide RNA (gRNA) having a targeting domain that is complementary to the at least one target site.

228. The method of embodiment 217-227, wherein the TRBC gene is one or both of a T cell receptor beta constant 1 (TRBC1) or T cell receptor beta constant 2 (TRBC2) gene.

229. The method of any of embodiments 221-228, wherein the genetic disruption is effected by one or more agent that comprises (a) a least one gRNA having a targeting domain that is complementary with a target domain of a TRAC gene and/or a TRBC gene or (b) at least one nucleic acid encoding the at least one gRNA.

230. The method of embodiment 229, wherein the one or more agent is introduced as a ribonucleoprotein (RNP) complex comprising the gRNA and a Cas9 protein.

231. The method of embodiment 230, wherein the RNP is introduced via electroporation, particle gun, calcium phosphate transfection, cell compression or squeezing.

232. The method of embodiment 230 or embodiment 231, wherein the RNP is introduced via electroporation.

233. The method of any of embodiments 227-232, wherein the one or more agent is introduced as one or more polynucleotide encoding the gRNA and/or a Cas9 protein.

234. The method of any of embodiments 220-233, wherein the one or more agent comprises at least one complex of a Cas9 molecule and the at least one gRNA having a targeting domain that is complementary with a target domain of a TRAC gene and/or a TRBC gene.

235. The method of any of embodiments 220-234, wherein the one or more agent comprises at least one complex of a Cas9 molecule and a gRNA having a targeting domain that is one or both of (1) complementary with a target domain of a TRAC gene, said targeting domain comprising the sequence selected from any of SEQ ID NOS:1048 and 1229-1258; and (2) complementary with a target domain of a TRBC gene, optionally one or both of a TRBC1 and a TRBC2 gene said targeting domain comprising the sequence selected from any of SEQ ID NOS:1053 and 1259-1315.

236. The method of any of embodiments 229-235, wherein the targeting domain comprises a sequence complementary with a target domain of a TRAC gene and the targeting domain comprises the sequence GAGAAUCAAAAUCGGUGAAU (SEQ ID NO:1048).

237. The method of any of embodiments 229-236, wherein the targeting domain comprises a sequence complementary with a target domain of a TRBC gene and the targeting domain comprises the sequence GGC-CUCGGCGCUGACGAUCU (SEQ ID NO:1053).

238. The method of any of embodiments 229-237, wherein the guide RNA further comprises a first complementarity domain, a second complementarity domain that is complementary to the first complementarity domain, a proximal domain and optionally a tail domain.

239. The method of embodiment 238, wherein the first complementarity domain and second complementarity domain are joined by a linking domain.

240. The method of any of embodiments 239, wherein the guide RNA comprises a 3' poly-A tail and a 5' Anti-Reverse Cap Analog (ARCA) cap.

241. The method any of embodiments 226-240, wherein the Cas9 molecule is an enzymatically active Cas9.

242. The method of any of embodiments 226-241, wherein the Cas9 molecule is an *S. aureus* Cas9 molecule.

243. The method of any of embodiments 226-241, wherein the Cas9 molecule is an *S. pyogenes* Cas9.

244. The method of any of embodiments 220-243, wherein at least or greater than 35%, 40%, 45%, 50%, 55%, 60%, 65%, 70%, 75%, 80%, 90% or 95% of the cells in a plurality of engineered cells comprise a genetic disruption within the TRAC gene and/or TRBC gene.

245. The method of any of embodiments 220-244, wherein at least or greater than 90%, 95%, 96%, 97%, or 98% of the cells in a plurality of engineered cells comprise a genetic disruption within the TRAC gene and/or TRBC gene.

246. The method of any of embodiments 217-245, wherein at least or greater than 5%, 10%, 15%, 20%, 25%, 30%, 40%, 50% or more of the cells in a plurality of engineered cells express the introduced TCR or antigen-binding fragment thereof and/or exhibit antigen-binding to an HPV protein, optionally HPV E6 or HPV E7.

247. The method of any of embodiments 217-245, wherein at least or greater than 5%, 10%, 15%, 20%, 25%, 30%, 40%, 50% or more of the cells in a plurality of engineered cells express the introduced TCR or antigen-binding fragment thereof and/or exhibit antigen-binding to an HPV protein, optionally HPV E6 or HPV E7.

248. The method of any of embodiments 217-247, wherein at least or greater than 5%, 10%, 15%, 20%, 25%, 30%, 40%, 50% or more of the cells in a plurality of engineered cells express the introduced TCR or antigen-binding fragment thereof and/or exhibit antigen-binding to an HPV protein, optionally HPV E6 or HPV E7.

249. The method of any of embodiments 220-248, wherein the one or more agent(s) and the nucleic acid molecule, the polynucleotide or the vector are introduced simultaneously or sequentially, in any order.

250. The method of any of embodiments 220-249, wherein the nucleic acid molecule, the polynucleotide or the vector is introduced after the introduction of the one or more agent(s).

251. The method of embodiment 250, wherein the nucleic acid molecule, the polynucleotide or the vector is introduced immediately after, or within about 30 seconds, 1 minute, 2 minutes, 3 minutes, 4 minutes, 5 minutes, 6 minutes, 6 minutes, 8 minutes, 9 minutes, 10 minutes, 15 minutes, 20 minutes, 30 minutes, 40 minutes, 50 minutes, 60 minutes, 90 minutes, 2 hours, 3 hours or 4 hours after the introduction of the agent.

252. A composition comprising engineered cells of any of embodiments 139-216.

253. A composition comprising the engineered cells generated using the method of any of embodiments 217-251.

254. The composition of embodiment 252 or embodiment 253, wherein:
at least 70%, 75%, 80%, 90%, 91%, 92%, 93%, 94%, 95%, 96%, 97%, 98%, or 99% of the engineered cells in the composition comprise a genetic disruption in or of an endogenous T cell receptor alpha constant region (TRAC) gene and/or a T cell receptor beta constant region (TRBC) gene; and/or
at least 80%, 90%, 91%, 92%, 93%, 94%, 95%, 96%, 97%, 98%, or 99% of the engineered cells in the composition do not express or do not express detectable levels of a gene product of an endogenous TRAC or TRBC gene.

255. A composition comprising a plurality of engineered cells each comprising a TCR or antigen-binding fragment thereof, wherein:
(1) at least 70%, 75%, 80%, 90%, 91%, 92%, 93%, 94%, 95%, 96%, 97%, 98%, or 99% of the engineered cells in the composition comprise a genetic disruption in or of an endogenous T cell receptor alpha constant region (TRAC) gene and/or a T cell receptor beta constant region (TRBC) gene and/or wherein at least 80%, 90%, 91%, 92%, 93%, 94%, 95%, 96%, 97%, 98%, or 99% of the engineered cells in the composition do not express or do not express detectable levels of a gene product of an endogenous TRAC or TRBC gene; and
(2) the TCR or antigen-binding fragment thereof comprises:
(a) a variable alpha (Vα) region comprising the amino acid sequence set forth in any of SEQ ID NOs: 117, 119 or 295 or an amino acid sequence that has at least 90%, 91%, 92%, 93%, 94%, 95%, 96%, 97%, 98%, or 99% sequence identity thereto and a variable beta (Vβ) region comprising the amino acid sequence set forth in any of SEQ ID NOs: 118, 120, or 296, or an amino acid sequence that has at least 90%, 91%, 92%, 93%, 94%, 95%, 96%, 97%, 98%, or 99% sequence identity thereto; and/or
(b) a Vα region comprising a complementarity determining region 3 (CDR-3) comprising the amino acid sequence set forth in any of SEQ ID NOs: 153, 159, or 301, or a CDR3 contained within the amino acid sequence set forth in any of SEQ ID NOs: 117, 119, or 295 and a Vβ region comprising a complementarity determining region 3 (CDR-3) comprising an amino acid sequence set forth in any of SEQ ID NOs:

156 or 160 or a CDR3 contained within the amino acid sequence set forth in any of SEQ ID NOs: 118, 120, or 296.

256. The composition of embodiment 255, wherein:
the Vα region further comprises a complementarity determining region 1 (CDR-1) comprising an amino acid sequence set forth in any of SEQ ID NOs: 151 or 157; and/or a complementarity determining region 2 (CDR-2) comprising an amino acid sequence set forth in any of SEQ ID NOs: 152 or 158; and/or
the Vβ region comprises further comprises a complementarity determining region 1 (CDR-1) comprising the amino acid sequence set forth in SEQ ID NO: 154; and/or a complementarity determining region 2 (CDR-2) comprising the amino acid sequence set forth in SEQ ID NO: 155.

257. The composition of embodiment 255 or embodiment 256, wherein the Vα region and Vβ region comprise:
a CDR-1, CDR-2, and CDR-3, comprising the amino acid sequences of SEQ ID NOs: 151, 152, and 153, respectively, and the Vβ region comprises a CDR-1, CDR-2, and CDR-3, comprising the amino acid sequences of SEQ ID NOs: 154, 155, and 156, respectively;
a CDR-1, CDR-2, and CDR-3, comprising the amino acid sequences of SEQ ID NOs: 157, 158, and 159, respectively, and the Vβ region comprises a CDR-1, CDR-2, and CDR-3, comprising the amino acid sequences of SEQ ID NOs: 154, 155, and 160, respectively; or
a CDR-1, CDR-2, and CDR-3, comprising the amino acid sequences of SEQ ID NOs: 151, 152, and 301, respectively, and the Vβ region comprises a CDR-1, CDR-2, and CDR-3, comprising the amino acid sequences of SEQ ID NOs: 154, 155, and 156, respectively.

258. The composition of any of embodiments 255-257, wherein:
the Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 117, 119, or 295; and/or
the Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 118, 120, or 296.

259. The composition of any of embodiments 255-258:
the Vα and Vβ regions comprise the amino acid sequences of SEQ ID NOs: 117 and either 118 or 296, respectively;
the Vα and Vβ regions comprise the amino acid sequences of SEQ ID NOs: 119 and 120, respectively; or
the Vα and Vβ regions comprise the amino acid sequences of SEQ ID NOs: 295 and either 118 or 296, respectively.

260. The composition of any of embodiments 255-259, wherein the TCR or antigen-binding fragment thereof binds to or recognizes a peptide epitope of human papillomavirus (HPV) 16 E7 in the context of an MHC molecule, the peptide epitope is or comprises E7(11-19) YMLDLQPET (SEQ ID NO:236).

261. A composition comprising a plurality of engineered cells each comprising a TCR or antigen-binding fragment thereof, wherein:
(1) at least 70%, 75%, 80%, 90%, 91%, 92%, 93%, 94%, 95%, 96%, 97%, 98%, or 99% of the engineered cells in the composition comprise a genetic disruption in or of an endogenous T cell receptor alpha constant region (TRAC) gene and/or a T cell receptor beta constant region (TRBC) gene and/or wherein at least 80%, 90%, 91%, 92%, 93%, 94%, 95%, 96%, 97%, 98%, or 99% of the engineered cells in the composition do not express or do not express detectable levels of a gene product of an endogenous TRAC or TRBC gene; and
(2) the TCR or antigen-binding fragment thereof, or the recombinant TCR or antigen-binding fragment thereof, comprises:
(a) a variable alpha (Vα) region Vα region comprising the amino acid sequence set forth in any of SEQ ID NOs: 111, 113, 115, 121, 123, 125, 297, or 299 or an amino acid sequence that has at least 90%, 91%, 92%, 93%, 94%, 95%, 96%, 97%, 98%, or 99% sequence identity thereto; and/or a Vβ region comprising the amino acid sequence set forth in any of SEQ ID NOs: SEQ ID NOs: 112, 114, 116, 122, 124, 126, 298, or 300, or an amino acid sequence that has at least 90%, 91%, 92%, 93%, 94%, 95%, 96%, 97%, 98%, or 99% sequence identity thereto; and/or
(b) a Vα region comprising a complementarity determining region 3 (CDR-3) comprising the amino acid sequence set forth in any of SEQ ID NOs: 138, 144, 147, 163, 167, 173, 304, or 308, or a CDR3 contained within the amino acid sequence set forth in any of SEQ ID NOs: 111, 113, 115, 121, 123, 125, 297, or 299 and a Vβ region comprising a complementarity determining region 3 (CDR-3) comprising the amino acid sequence set forth in any of SEQ ID NOs: 141, 146, 150, 164, 170, 174, 305, or 309, or a CDR3 contained within the amino acid sequence set forth in any of SEQ ID NOs: 112, 114, 116, 122, 124, 126, 298, or 300.

262. The composition of embodiment 261, wherein:
the Vα region further comprises a complementarity determining region 1 (CDR-1) comprising an amino acid sequence set forth in any of SEQ ID NOs: 136, 142, 161, 165, 171, 302, or 306, or a CDR-1 contained within the amino acid sequence set forth in any of SEQ ID NOs: 111, 113, 115, 121, 123, 125, 297, or 299; and/or a complementarity determining region 2 (CDR-2) comprising an amino acid sequence set forth in any of SEQ ID NOs: 137, 143, 162, 166, 172, 303, or 307, or a CDR-2 contained within the amino acid sequence set forth in any of SEQ ID NOs: 111, 113, 115, 121, 123, 125, 297, or 299; and/or
the Vβ region comprises further comprises a complementarity determining region 1 (CDR-1) comprising an amino acid sequence set forth in any of SEQ ID NOs: 139, 145, 148, 168, or a CDR-1 contained within the amino acid sequence set forth in any of SEQ ID NOs: 112, 114, 116, 122, 124, 126, 298, or 300; and/or a complementarity determining region 2 (CDR-2) comprising an amino acid sequence set forth in any of SEQ ID NOs: 140, 149, or 169 or a CDR-2 contained within the amino acid sequence set forth in any of SEQ ID NOs: 112, 114, 116, 122, 124, 126, 298, or 300.

263. The composition of embodiment 261 or embodiment 262, wherein:
the Vα region comprises a CDR-1, CDR-2, and CDR-3, comprising the amino acid sequences of SEQ ID NOs: 136, 137, and 138, respectively, and the Vβ region comprises a CDR-1, CDR-2, and CDR-3, comprising the amino acid sequences of SEQ ID NOs: 139, 140, and 141, respectively;
the Vα region comprises a CDR-1, CDR-2, and CDR-3, comprising the amino acid sequences of SEQ ID NOs: 142, 143, and 144, respectively, and the Vβ region comprises a CDR-1, CDR-2, and CDR-3, comprising the amino acid sequences of SEQ ID NOs: 145, 140, and 146, respectively;
the Vα region comprises a CDR-1, CDR-2, and CDR-3, comprising the amino acid sequences of SEQ ID NOs: 136, 137, and 147, respectively, and the Vβ region comprises a CDR-1, CDR-2, and CDR-3, comprising the amino acid sequences of SEQ ID NOs: 148, 149, and 150, respectively;
the Vα region comprises a CDR-1, CDR-2, and CDR-3, comprising the amino acid sequences of SEQ ID NOs: 161, 162, and 163, respectively, and the Vβ region comprises a CDR-1, CDR-2, and CDR-3, comprising the amino acid sequences of SEQ ID NOs: 148, 149, and 164, respectively;
the Vα region comprises a CDR-1, CDR-2, and CDR-3, comprising the amino acid sequences of SEQ ID NOs: 165, 166, and 167, respectively, and the Vβ region comprises a CDR-1, CDR-2, and CDR-3, comprising the amino acid sequences of SEQ ID NOs: 168, 169, and 170, respectively;
the Vα region comprises a CDR-1, CDR-2, and CDR-3, comprising the amino acid sequences of SEQ ID NOs: 171, 172, and 173, respectively, and the Vβ region comprises a CDR-1, CDR-2, and CDR-3, comprising the amino acid sequences of SEQ ID NOs: 148, 149, and 174, respectively;
the Vα region comprises a CDR-1, CDR-2, and CDR-3, comprising the amino acid sequences of SEQ ID NOs: 302, 303, and 304, respectively, and the Vβ region comprises a CDR-1, CDR-2, and CDR-3, comprising the amino acid sequences of SEQ ID NOs: 139, 140, and 305, respectively;
the Vα region comprises a CDR-1, CDR-2, and CDR-3, comprising the amino acid sequences of SEQ ID NOs: 306, 307, and 308, respectively, and the Vβ region comprises a CDR-1, CDR-2, and CDR-3, comprising the amino acid sequences of SEQ ID NOs: 148, 149, and 309, respectively.

264. The composition of any of embodiments 261-263, wherein:
the Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 111, 113, 115, 121, 123, 125, 297, or 299; and/or
the Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 112, 114, 116, 122, 124, 126, 298, or 300.

265. The composition of any of embodiments 261-264:
the Vα and Vβ regions comprise the amino acid sequences of SEQ ID NOs: 111 and 112, respectively;
the Vα and Vβ regions comprise the amino acid sequences of SEQ ID NOs: 113 and 114, respectively;
the Vα and Vβ regions comprise the amino acid sequences of SEQ ID NOs: 115 and 116, respectively;
the Vα and Vβ regions comprise the amino acid sequences of SEQ ID NOs: 121 and 122, respectively;
the Vα and Vβ regions comprise the amino acid sequences of SEQ ID NOs: 123 and 124, respectively;
the Vα and Vβ regions comprise the amino acid sequences of SEQ ID NOs: 125 and 126, respectively;
the Vα and Vβ regions comprise the amino acid sequences of SEQ ID NOs: 297 and 298, respectively;
the Vα and Vβ regions comprise the amino acid sequences of SEQ ID NOs: 299 and 300, respectively.

266. The composition of any of embodiments 261-265, wherein the TCR or antigen-binding fragment thereof binds to or recognizes a peptide epitope of human papillomavirus (HPV) 16 E6 in the context of an MHC molecule, the peptide epitope is or comprises E6(29-38) TIHDIILECV (SEQ ID NO:233).

267. The composition of any of embodiments 255-266, wherein the alpha chain further comprises an alpha constant (Cα) region and/or the beta chain further comprises a beta constant (Cβ) region.

268. The composition of any of embodiments 252-267, wherein at least or greater than 90%, 95%, 96%, 97%, or 98% of the cells in the composition contain a genetic disruption of an endogenous TRAC gene and/or TRBC gene and/or do not express or do not express detectable levels of a gene product of an endogenous TRAC or TRBC gene.

269. The composition of any of embodiments 252-268, wherein at least or greater than 70%, 75%, 80%, 85%, 90%, 95%, 96%, 97%, or 98% of the cells in the composition (i) express the engineered or recombinant TCR or antigen-binding fragment thereof and (ii) contain the genetic disruption of an endogenous TRAC gene and/or TRBC gene and/or do not express or do not express detectable levels of a gene product of an endogenous TRAC or TRBC gene.

270. The composition of any of embodiments 254-259, wherein the TRBC gene is one or both of a T cell receptor beta constant 1 (TRBC1) or T cell receptor beta constant 2 (TRBC2) gene.

271. The composition of any of embodiments 254-260, wherein the gene product is an mRNA or protein encoded by the TRAC or TRBC gene.

272. The composition of any of embodiments 252-271, wherein the engineered cells comprise CD4+ and/or CD8+ T cells.

273. The composition of any of embodiments 252-272, wherein the engineered cells comprise CD4+ and CD8+ T cells.

274. A composition, comprising an engineered CD8+ cell of embodiment 215 and an engineered CD4+ cell of embodiment 216.

275. The composition of any of embodiments 252-274, wherein the TCR or antigen-binding fragment thereof binds to or recognizes a peptide epitope of HPV 16 in the context of an MHC molecule that is at least partially CD8-independent.

276. The composition of any of embodiments 272-275, wherein the CD8+ cell and CD4+ cell are engineered with the same TCR or antigen-binding fragment thereof and/or are each engineered with a TCR or antigen-binding fragment thereof that binds to or recognizes the same peptide epitope of HPV 16 in the context of an MHC molecule.

277. The composition of any of embodiments 254-276, wherein:
the genetic disruption comprises a mutation or deletion in a region of the TRAC or TRBC gene that is within a coding region, optionally an early coding region of the gene, is within exon 1 of the gene, is in the coding region within 500, 400, 300, 200, 100, or 50 base pairs of a start codon of the gene, is within a target site sequence that is complementary to the targeting site of a gRNA targeting domain having a sequence selected from any of SEQ ID NOS:1053 and 1259-1315, and/or to which a targeting domain having a sequence selected from among SEQ ID NOS:1053 and 1259-1315 specifically hybridizes, and/or is within a target site sequence that is complementary to the targeting site of a gRNA targeting domain having a sequence selected from any of SEQ ID NOS: 1048 and 1229-1258, and/or to which a targeting domain having a sequence selected from among SEQ ID NOS: 1048 and 1229-1258 specifically hybridizes.

278. The composition of embodiment 274-277, wherein at least one of the engineered cells is a cell according to any of embodiments 1-141.

279. The composition of any of embodiments 252-278, wherein the genetic disruption is effected by one or more agent that comprises (a) a least one gRNA having a targeting domain that is complementary with a target domain of a TRAC gene and/or a TRBC gene or (b) at least one nucleic acid encoding the at least one gRNA.

280. The composition of embodiment 279, wherein the one or more agent is introduced as a ribonucleoprotein (RNP) complex comprising the gRNA and a Cas9 protein.

281. The composition of embodiment 280, wherein the RNP is introduced via electroporation, particle gun, calcium phosphate transfection, cell compression or squeezing.

282. The composition of embodiment 280 or embodiment 281, wherein the RNP is introduced via electroporation.

283. The composition of any of embodiments 279-282, wherein the one or more agent is introduced as one or more polynucleotide encoding the gRNA and/or a Cas9 protein.

284. The composition of any of embodiments 279-283, wherein the one or more agent comprises at least one complex of a Cas9 molecule and the at least one gRNA having a targeting domain that is complementary with a target domain of a TRAC gene and/or a TRBC gene.

285. The composition of any of embodiments 279-284, wherein the one or more agent comprises at least one complex of a Cas9 molecule and a gRNA having a targeting domain that is one or both of (1) complementary with a target domain of a TRAC gene, said targeting domain comprising the sequence selected from any of SEQ ID NOS:1048 and 1229-1258; and (2) complementary with a target domain of a TRBC gene, optionally one or both of a TRBC1 and a TRBC2 gene said targeting domain comprising the sequence selected from any of SEQ ID NOS:1053 and 1259-1315.

286. The composition of any of embodiments 279-285, wherein the targeting domain comprises a sequence complementary with a target domain of a TRAC gene and the targeting domain comprises the sequence GAGAAUCAAAAUCGGUGAAU (SEQ ID NO:1048).

287. The composition of any of embodiments 279-286, wherein the targeting domain comprises a sequence complementary with a target domain of a TRBC gene and the targeting domain comprises the sequence GGC-CUCGGCGCUGACGAUCU (SEQ ID NO:1053).

288. The composition of any of embodiments 279-287, wherein the guide RNA further comprises a first complementarity domain, a second complementarity domain that is complementary to the first complementarity domain, a proximal domain and optionally a tail domain.

289. The composition of embodiment 288, wherein the first complementarity domain and second complementarity domain are joined by a linking domain.

290. The composition of any of embodiments 289, wherein the guide RNA comprises a 3' poly-A tail and a 5' Anti-Reverse Cap Analog (ARCA) cap.

291. The composition any of embodiments 279-290, wherein the Cas9 molecule is an enzymatically active Cas9.

292. The composition of any of embodiments 279-291, wherein the Cas9 molecule is an *S. aureus* Cas9 molecule.

293. The composition of any of embodiments 279-291, wherein the Cas9 molecule is an *S. pyogenes* Cas9.

294. The composition of any of embodiments 252-293, further comprising a pharmaceutically acceptable excipient.

295. A method of treatment, comprising administering the engineered cell of any of embodiments 139-216 to a subject having a disease or disorder associated with HPV.

296. A method of treatment, comprising administering the composition of any of embodiments 252-294 to a subject having a disease or disorder associated with HPV.

297. The method of embodiment 295 or embodiment 296, wherein the disease or disorder is associated with HPV16.

298. The method of any of embodiments 295-297, wherein the disease or disorder is cancer.

299. The method of any of embodiments 295-298, wherein the subject is a human.

300. A composition of any of embodiments 252-294 for use in treating a disease or disorder associated with HPV.

301. Use of a composition of any of embodiments 252-2954 for the manufacture of a medicament for treating a disease or disorder associated with HPV.

302. The composition of embodiment 300 or use of embodiment 301, wherein the disease or disorder is associated with HPV16.

303. The composition or use of any of embodiments 300-302, wherein the disease or disorder is cancer.

304. The composition or use of any of embodiments 300-303, wherein the subject is a human.

X. EXAMPLES

The following examples are included for illustrative purposes only and are not intended to limit the scope of the invention.

Example 1: Screening and Selection of HPV-16 E6 and E7 Epitope-Specific T Cell Receptors from Normal Donors An exemplary autologous screening process using autologous dendritic and T cells, generally as described by Ho et al., *J. Immunol. Methods,* 310:1-2, 40-52, with indicated modifications, was performed to generate antigen-specific T cells that specifically bound to peptide epitopes of human papillomavirus 16 (HPV16) E6 and E7 proteins presented on MHC-I molecules. Clonal T cell lines were generated and their TCR sequences cloned by this method were cloned.

A. Generation and Cloning of Human HPV-Specific T Cells and TCRs

Briefly, dendritic cells were derived from adherent fractions of peripheral blood mononuclear cell (PBMC) samples obtained from normal human HLA-A02:01 donors, by culturing over two days in the presence of GM-CSF and IL-4, followed by incubation beginning at day 3 in the presence of pro-inflammatory cytokines to produce mature dendritic cells. On Day 4, the resulting mature dendritic cells were harvested, washed and pulsed with HPV-16 E6- or E7-derived peptides, such as some of those shown in Table 23, including peptide epitopes E6 (29-38), E7 (11-19), and E7 (86-93).

TABLE 23

HPV-16 Epitopes

| Epitope Description | Epitope Name | SEQ ID NO. |
|---|---|---|
| KLPQLCTEL | E6(18-26) | 232 |
| TIHDIILECV | E6(29-38) | 233 |
| FAFRDLCIV | E6(52-60) | 234 |
| TLGIVCPI | E7(86-93) | 235 |
| YMLDLQPET | E7(11-19) | 236 |
| GTLGIVCPI | E7(85-93) | 237 |
| LLMGTLGIV | E7(82-90) | 238 |
| TLHEYMLDL | E7(7-15) | 239 |

On Day 5, autologous CD8+ T cells from normal human donors were incubated with the peptide-pulsed dendritic cells.

On Day 8, IFNγ in the cultures was measured as an indicator for cultures containing antigen-specific T cells. Cells from reactive co-cultures were selected and re-stimulated two or three times with peptide-pulsed dendritic cells to enrich for specific T cells. Following the repeated stimulations, populations of cells staining positive for peptide-loaded autologous MHC tetramers were identified by flow cytometry. Clonal lines were generated by cell sorting and/or limiting dilution cloning essentially as described by Ho et al. 2006.

Clones were cultured with peptide-pulsed T2 cells (cells deficient in transporter associated with antigen transport (TAP) but expressing MHC-I and thus able to present peptides loaded onto the cells), pulsed with the relevant peptide, e.g. E6 (29-38), E7 (11-19) or E7 (86-93). Level of IFNγ in the cultures, as compared to those resulting from co-culture with cells loaded with a non-HPV-derived (negative control) peptide, was measured as an indicator of T cell specificity for the peptide-MHC and functional activity. Flow cytometry-based staining was used to assess the ability of the clonal cell lines to bind, in a peptide-specific manner, to labeled peptide-MHC (HLA-A02:01) tetramers (either HLA-A2/E6 (29-38), HLA-A2/E7 (11-19) or HLA-A2/E7 (86-93)); tetramers containing an irrelevant peptide served as a negative control).

Table 24 lists sequence identifiers corresponding to TCR alpha and beta chains expressed by clonal T cell lines generated via this process.

The ability of clonal lines to lyse target cells in an antigen-specific manner was assessed using peptide-pulsed T2 cells and/or cells of an antigen-expressing cancer cell line.

Figure 1:
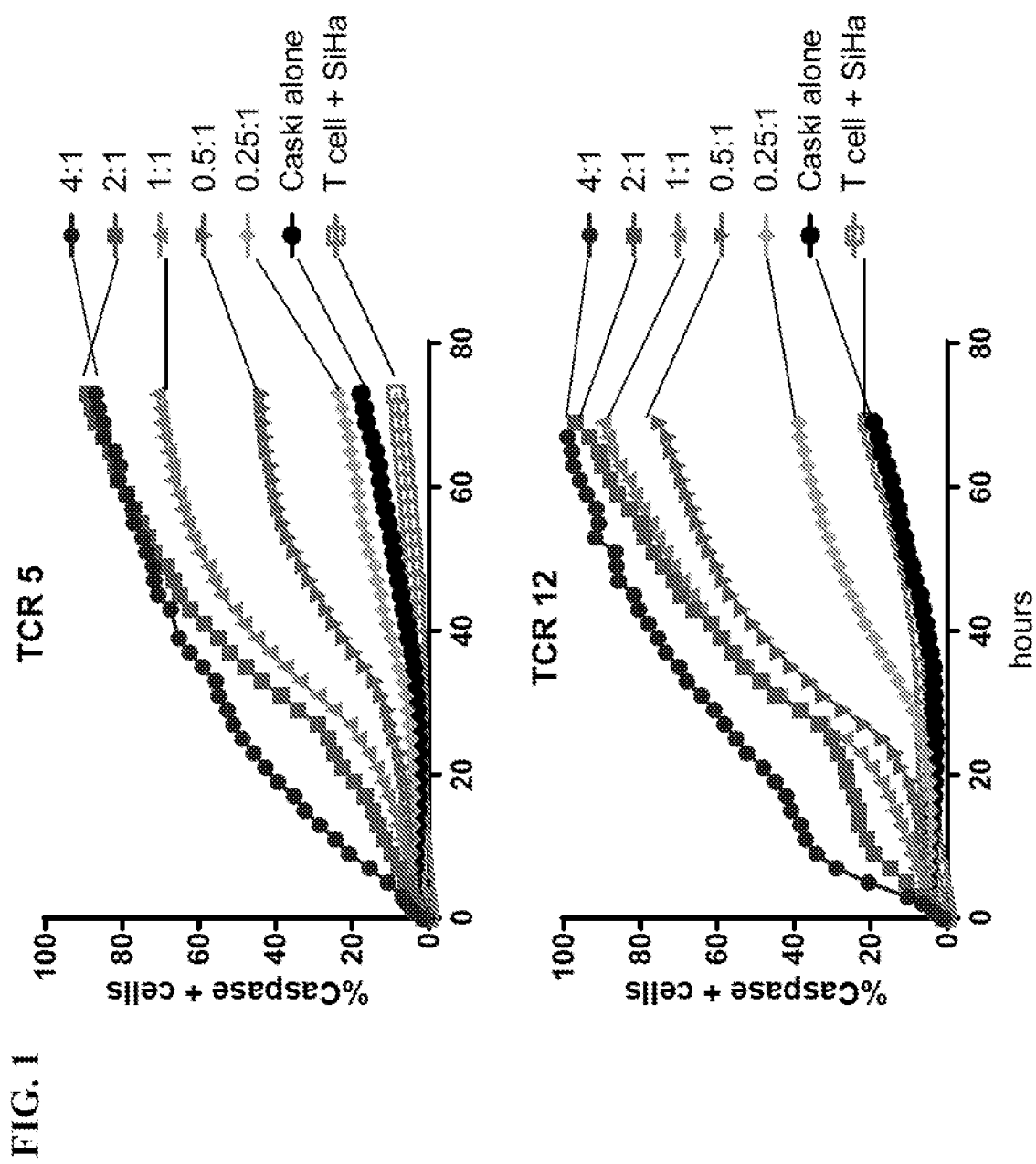
FIG. 1 shows lytic activity of monoclonal T cell lines expressing exemplary TCRs incubated with SiHa cells or Caski target cells based on the percent of caspase positive target cells at various assessed time points. Specifically, results are shown for T cell lines expressing the modified version of TCR 5 and the modified version of TCR 12.
Figure 2A:
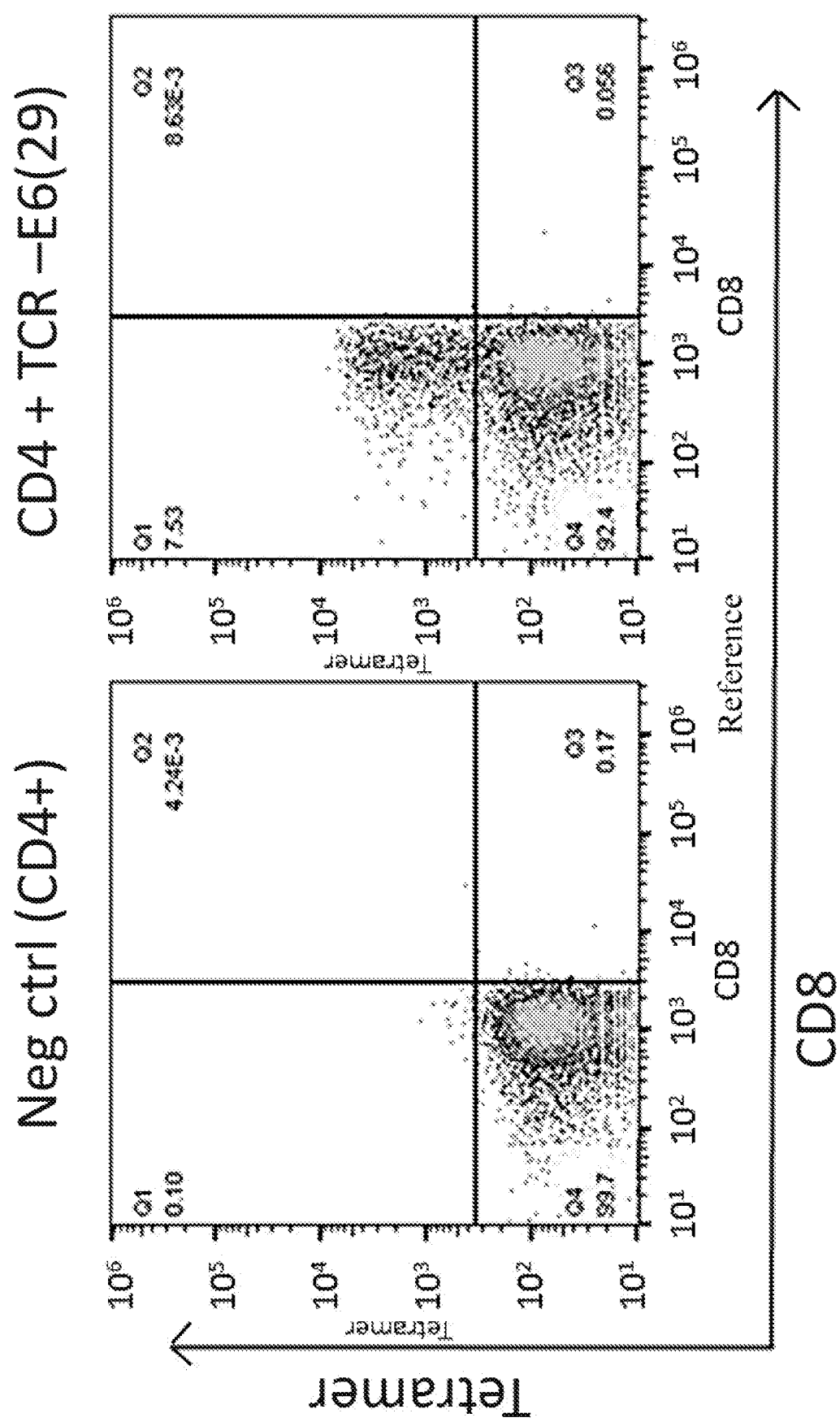
FIG. 2A-2L show flow cytometry results for tetramer binding by a CD4+ Jurkat-derived cell line (Neg ctrl CD4+), the CD4+ Jurkat-derived cell line expressing various E6(29-38)-specific TCRs (CD4+TCR-E6(29)), the CD4+ Jurkat-derived cell line that also expresses exogenous CD8 (CD8), or the CD4+ Jurkat-derived cell line that also expresses exogenous CD8 and various E6(29-38)-specific TCRs (CD8+ TCR-E6(29)). Specifically, results are shown for a reference TCR, the modified version of TCR 5, the modified version of TCR 4, the modified version of TCR 3 and the modified version of TCR 8.
Figure 2B:
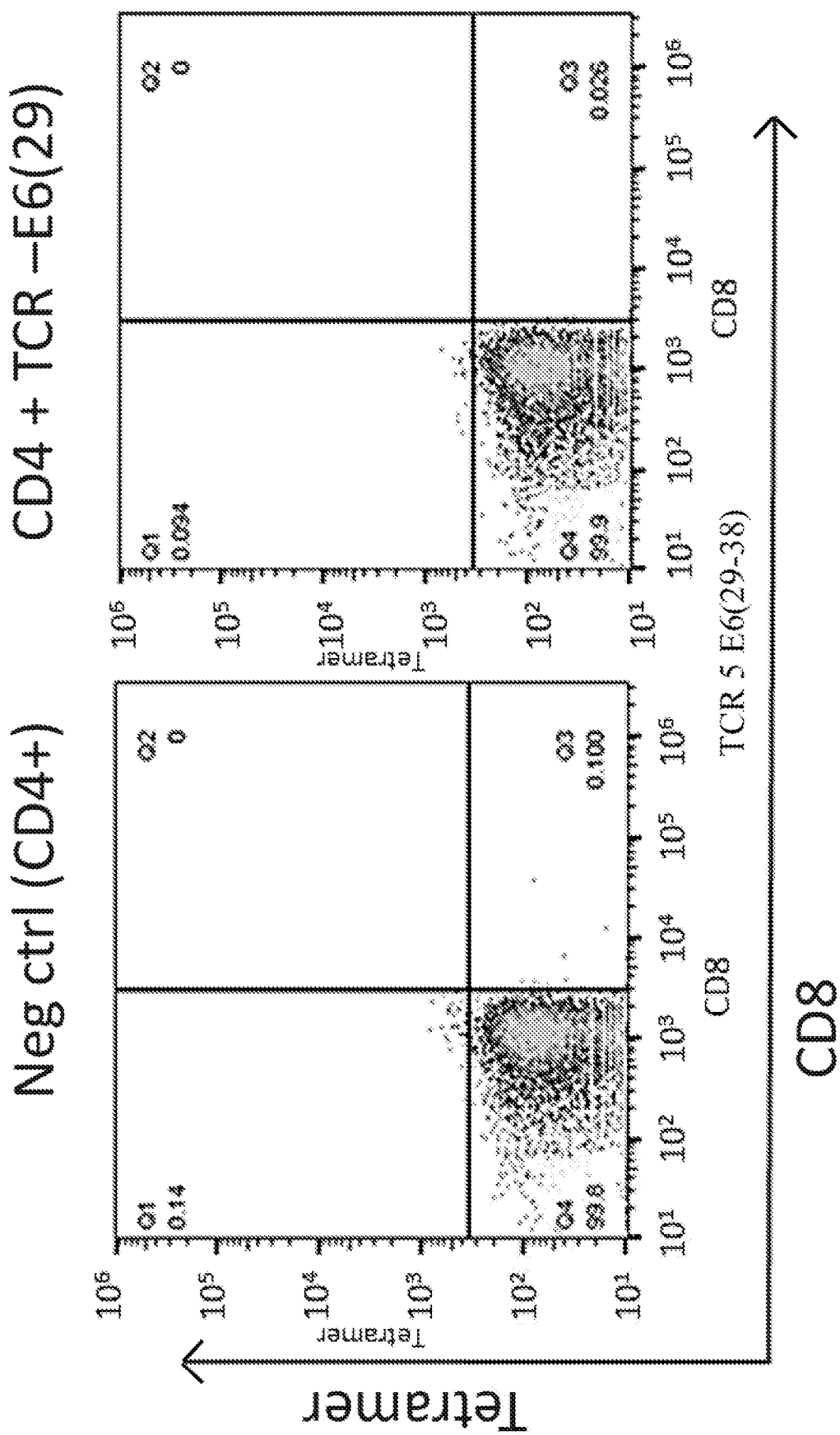
Figure 2C:
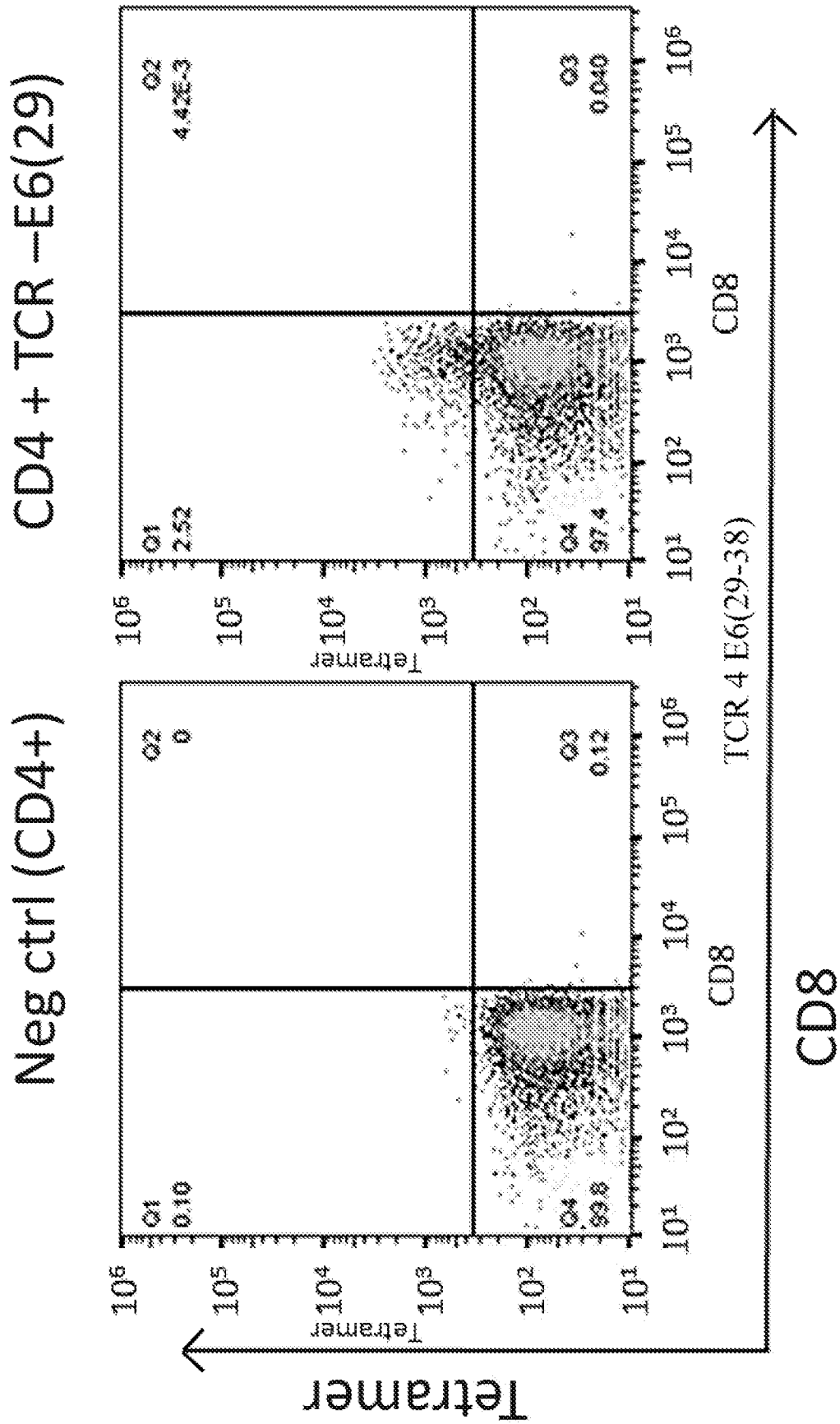
Figure 2D:
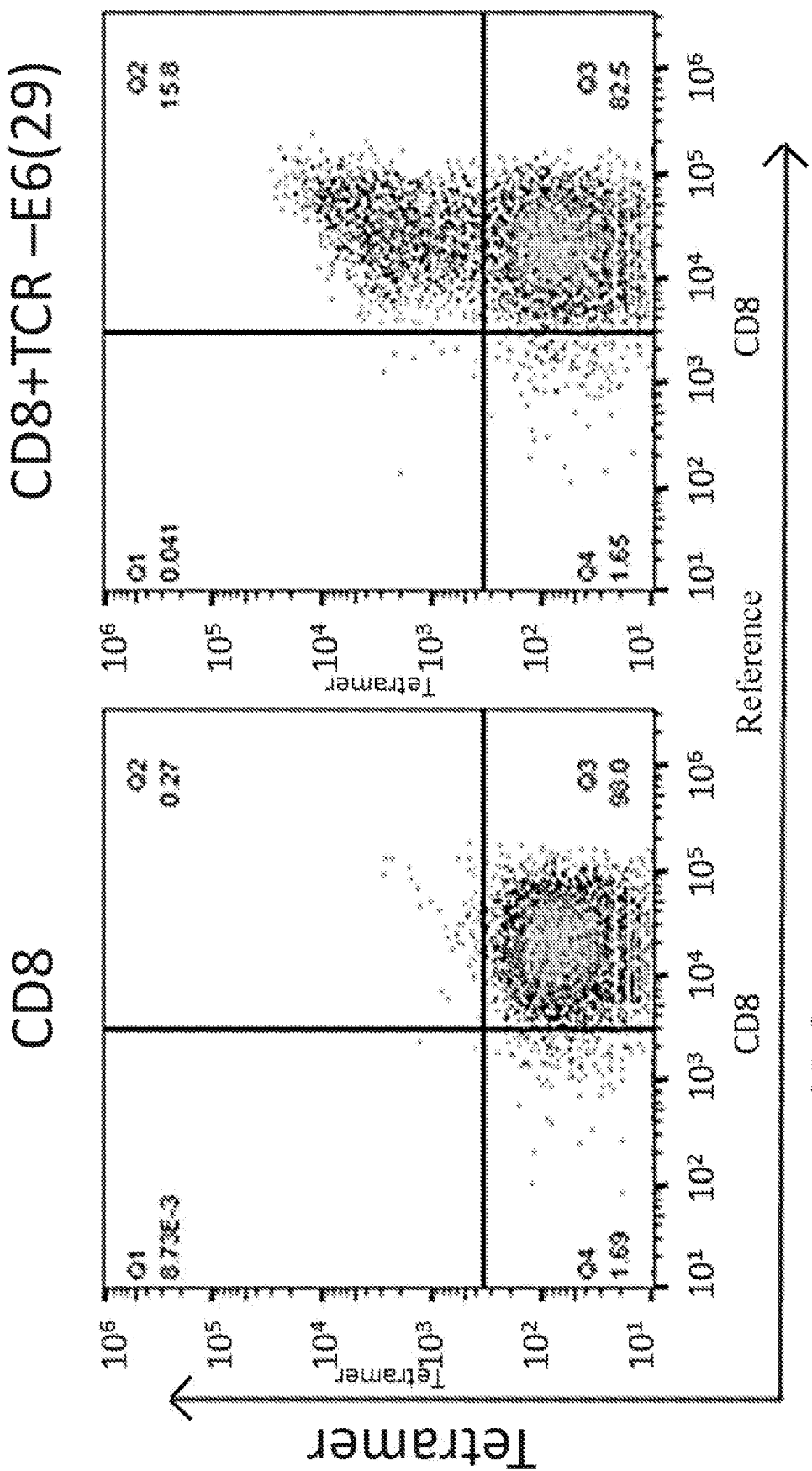
Figure 2E:
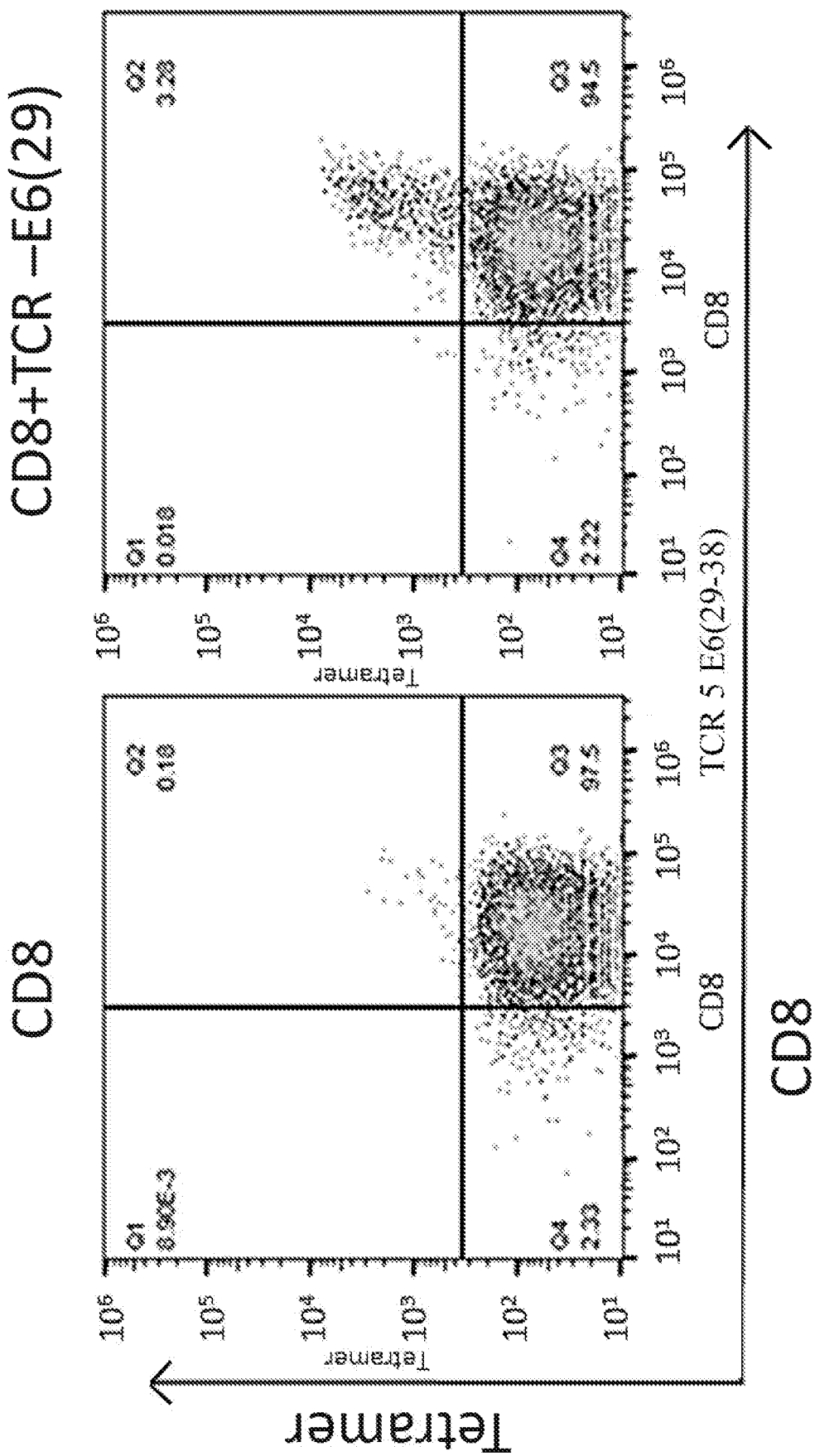
Figure 2F:
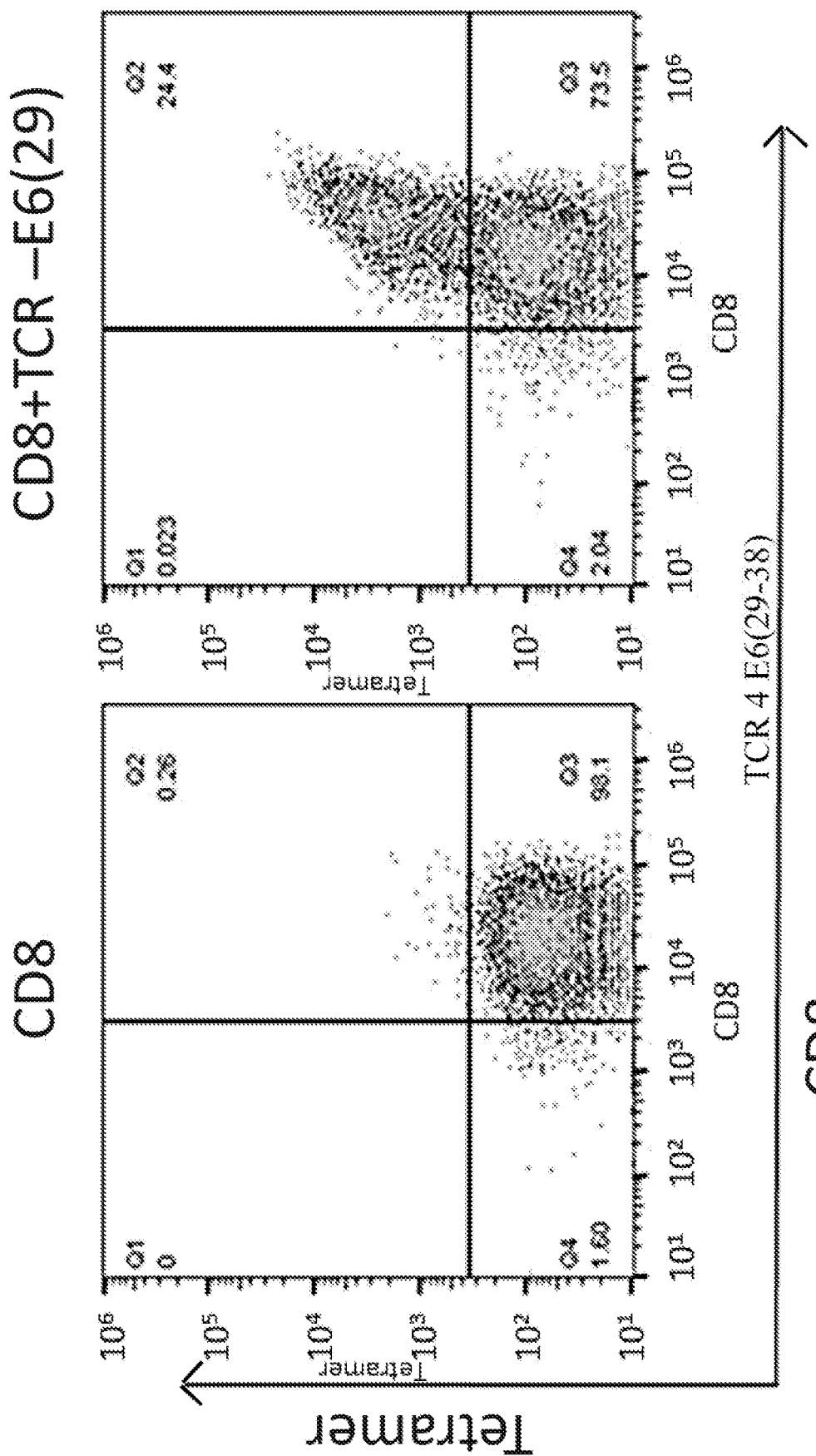
Figure 2G:
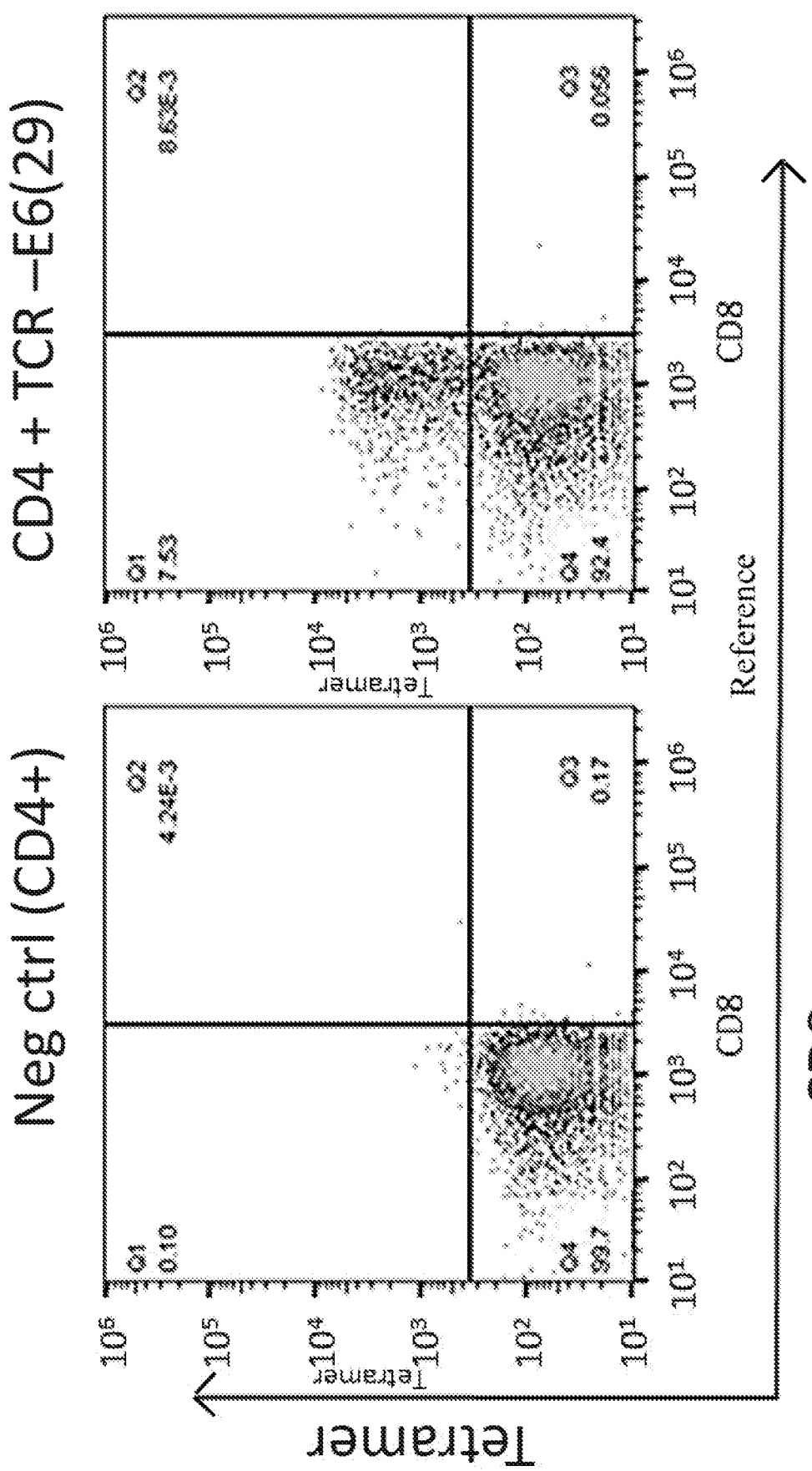
Figure 2H:
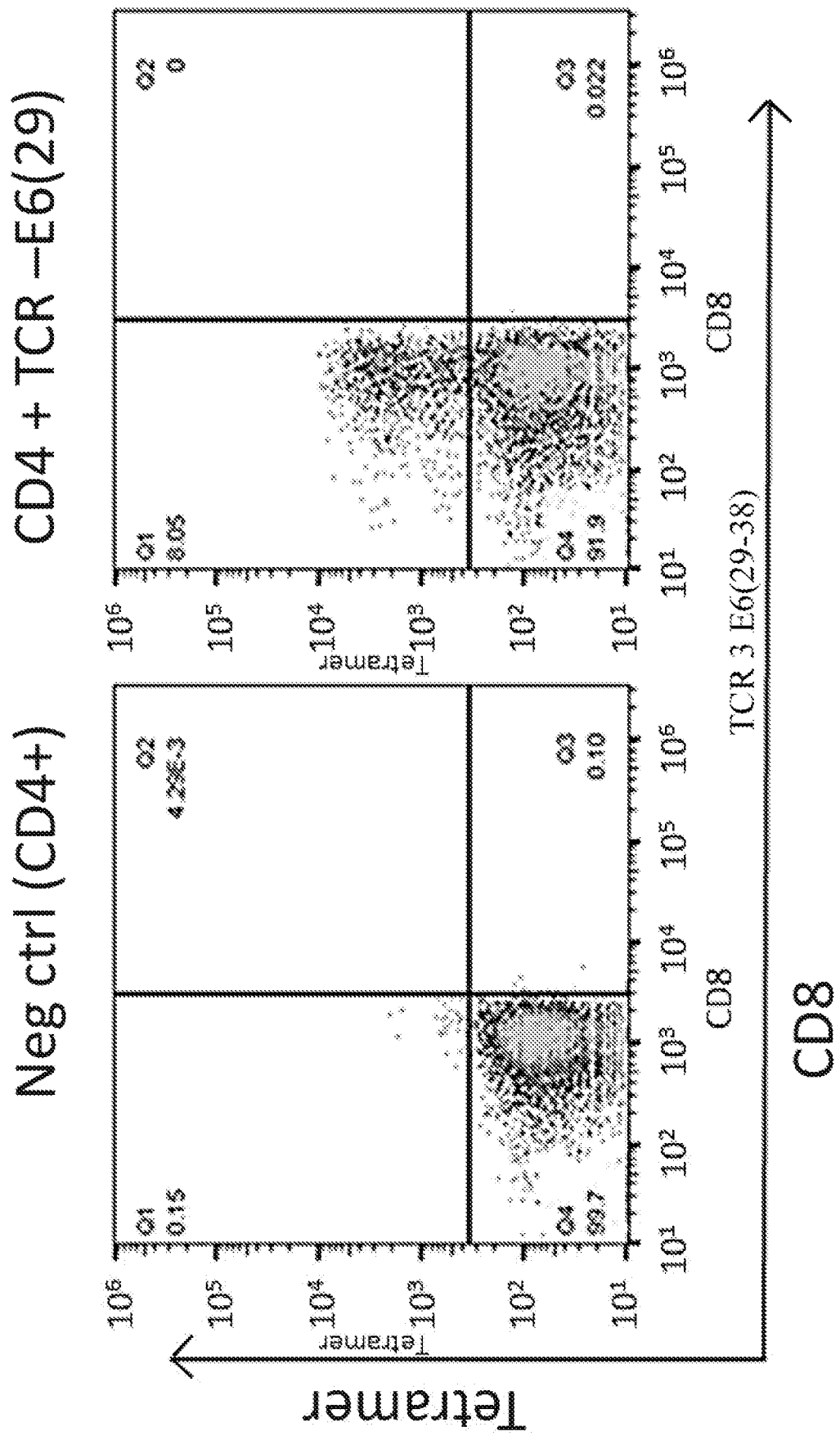
Figure 2I:
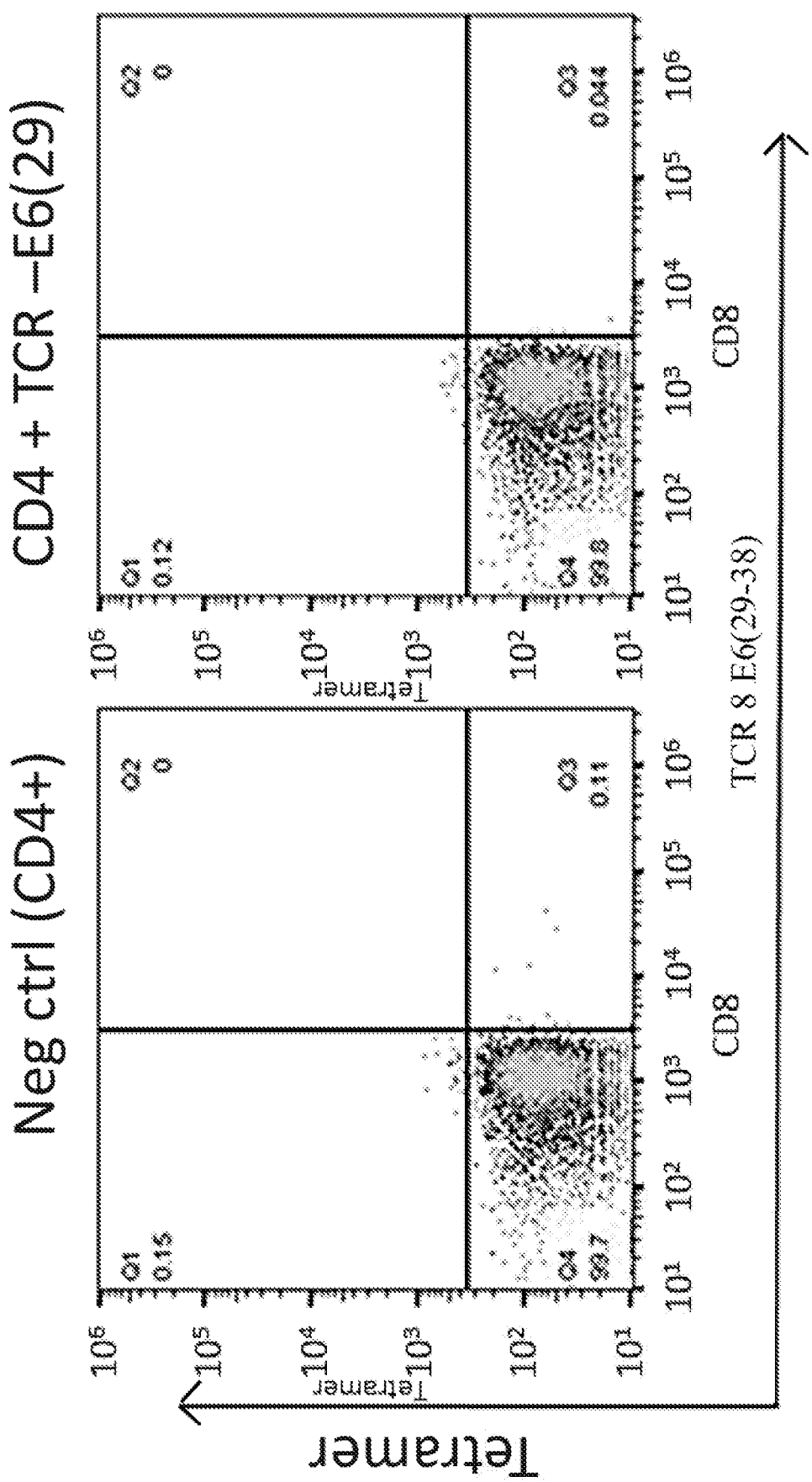
Figure 2J:
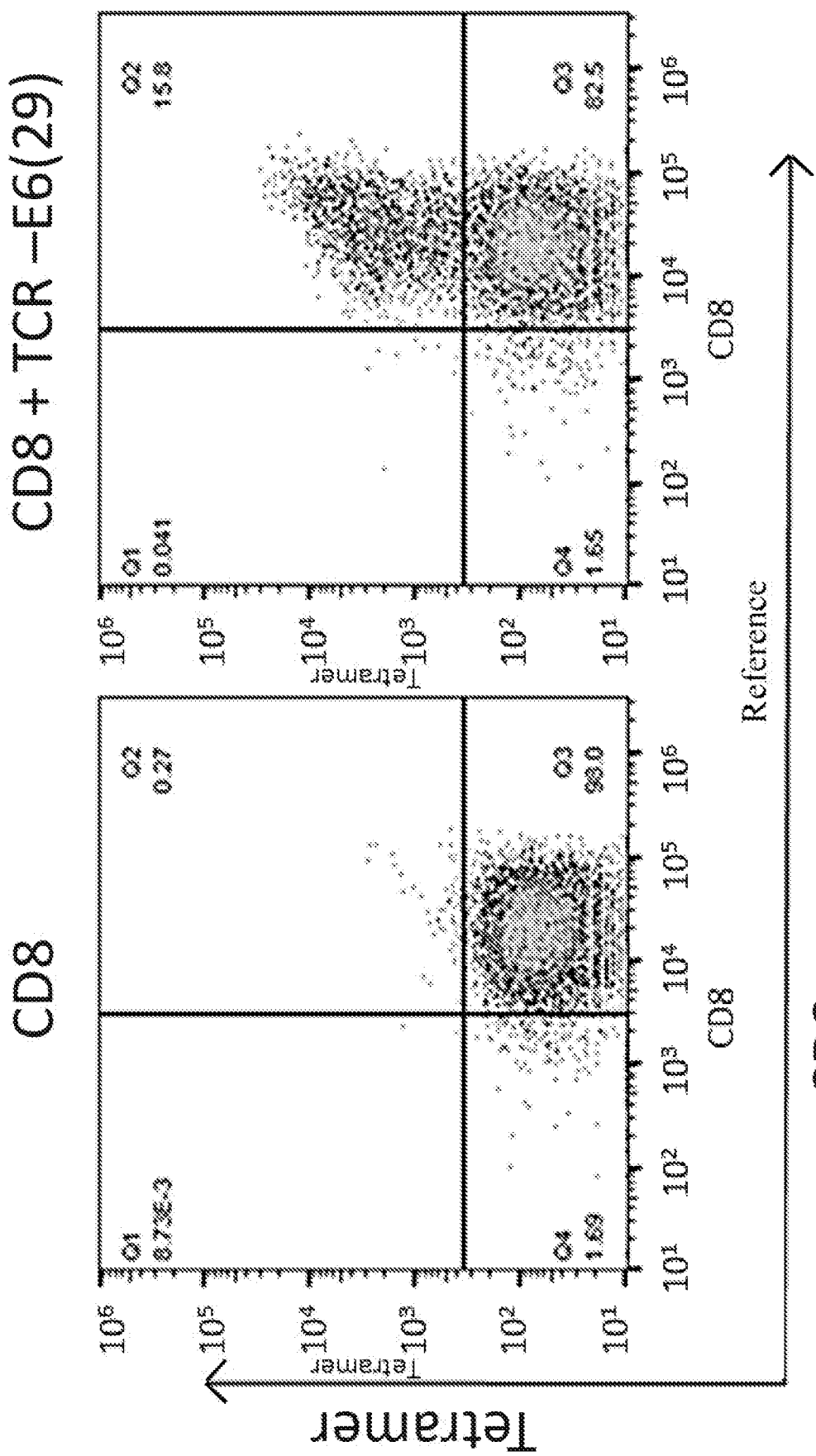
Figure 2K:
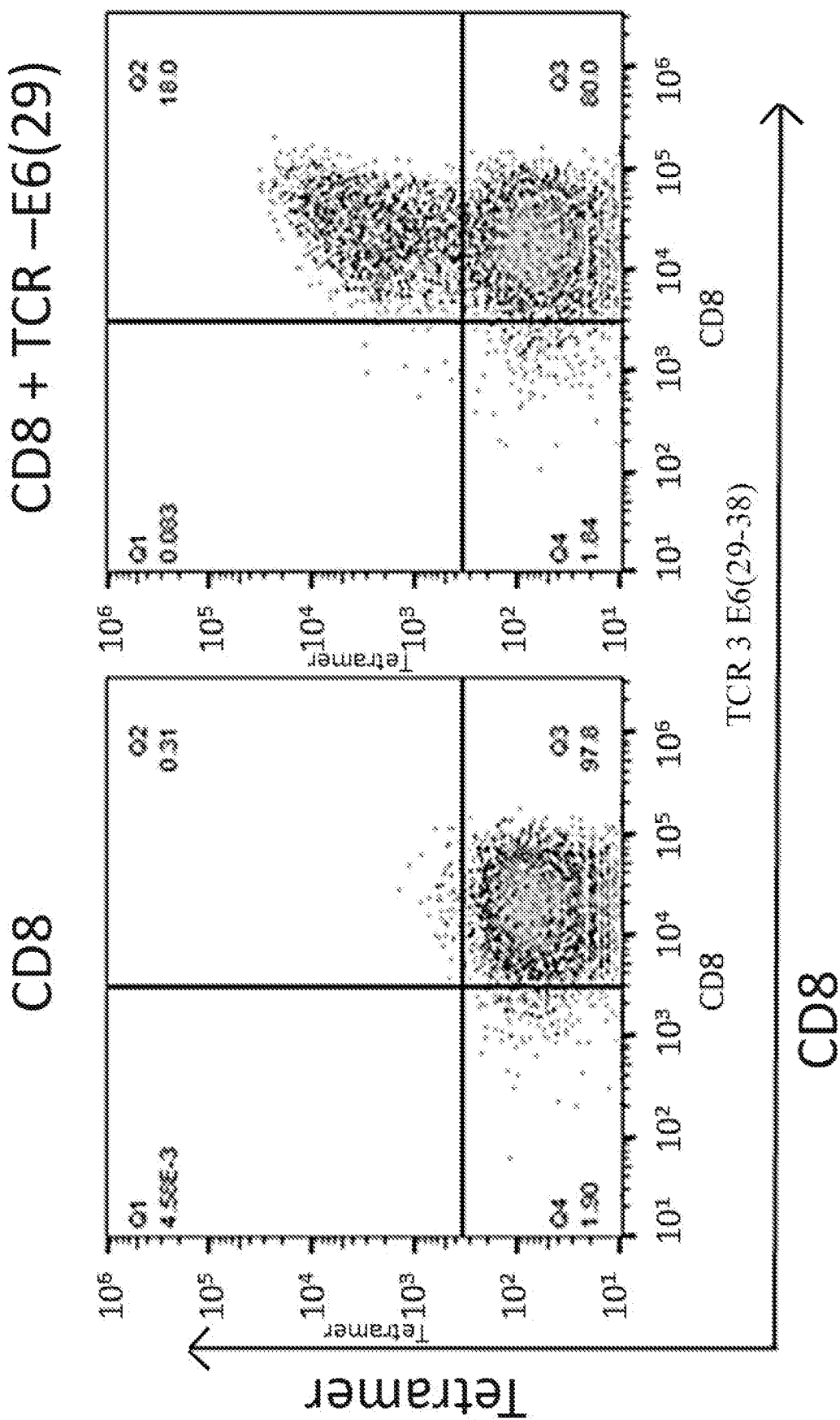
Figure 2L:
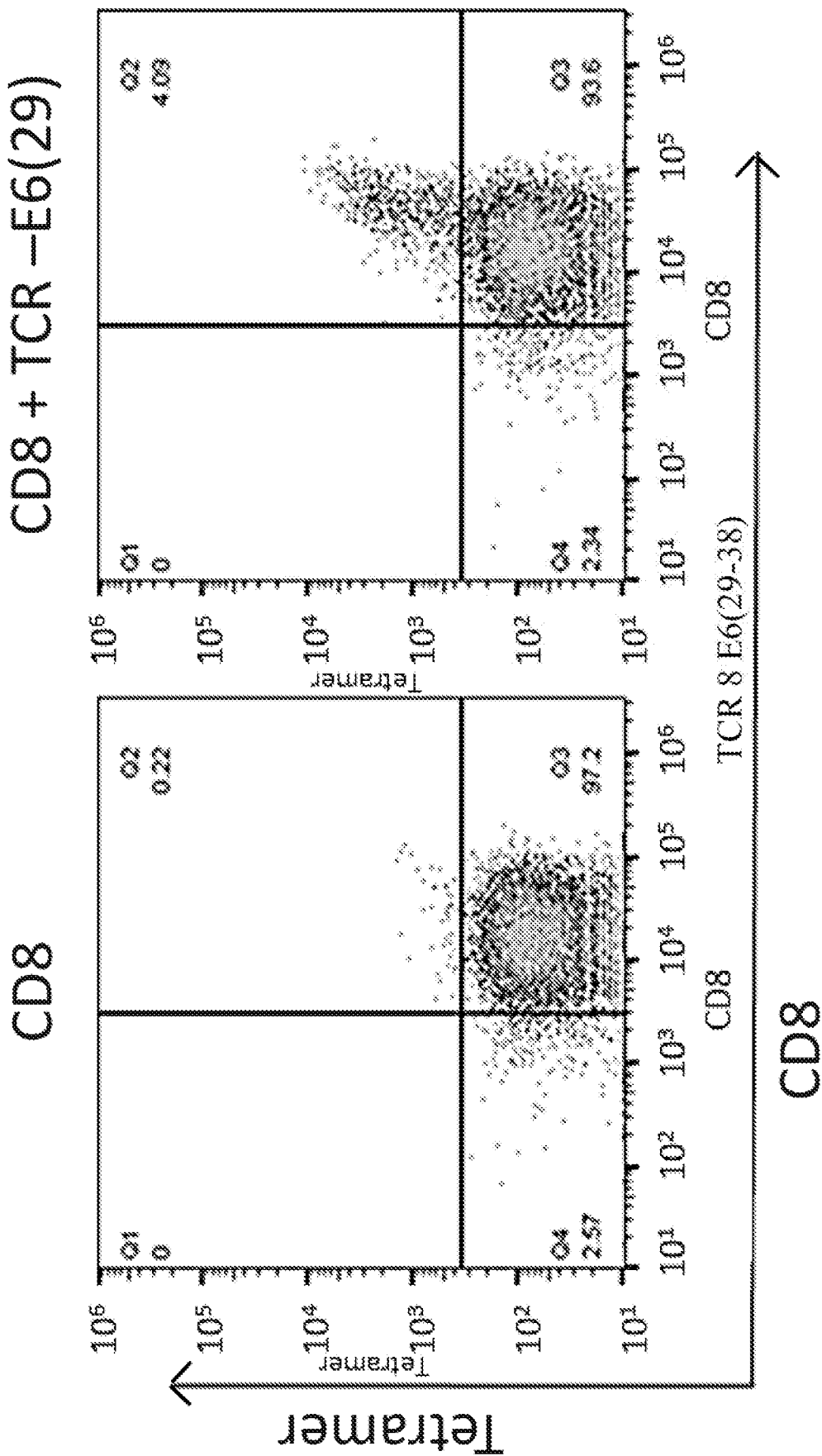
Figure 3A:
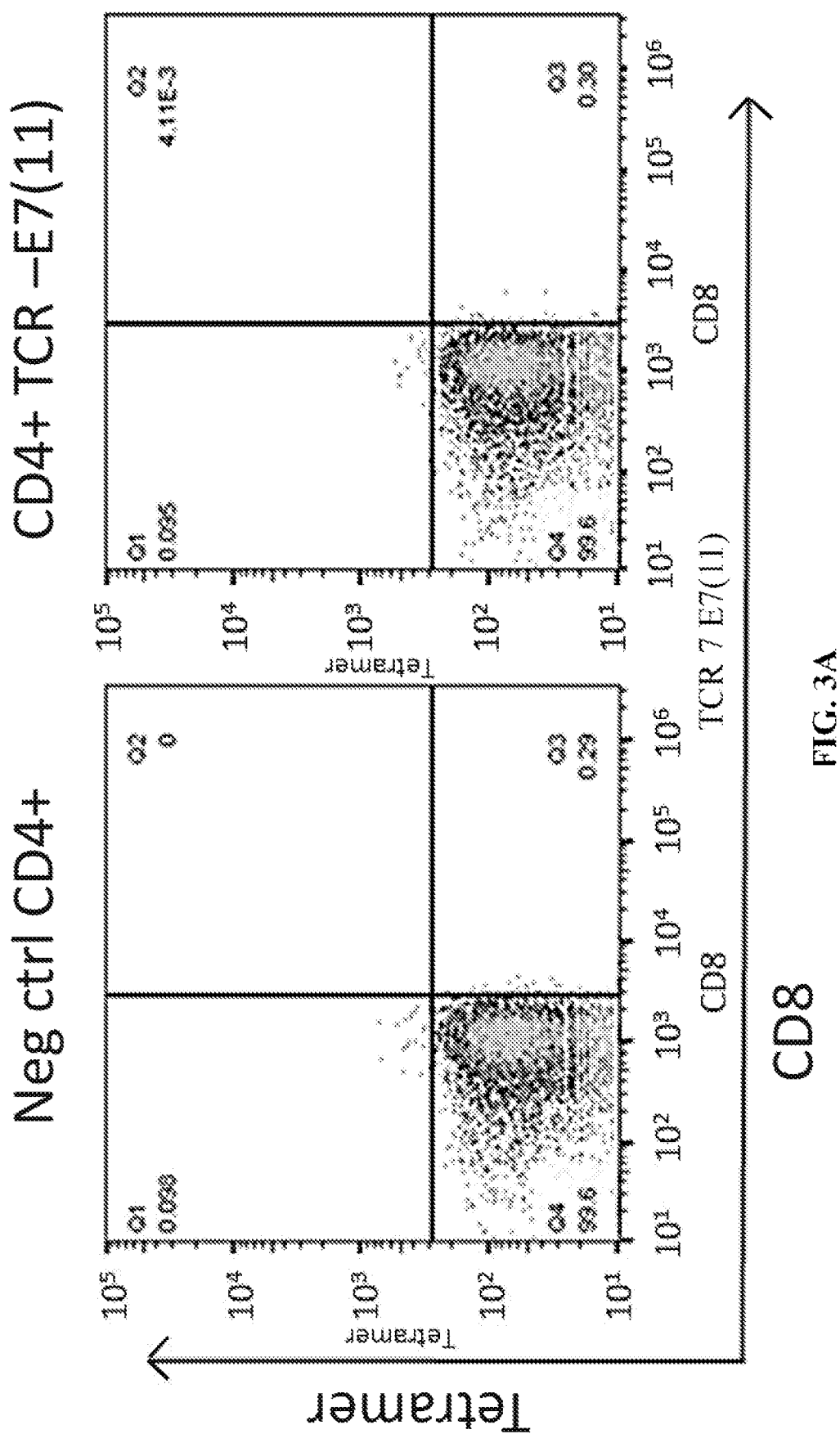
FIG. 3A-3D shows flow cytometry results for tetramer binding by CD4+ Jurkat-derived cell line (Neg ctrl CD4+), the CD4+ Jurkat-derived cell line expressing various E7(11-19)-specific TCRs (CD4+ TCR-E7(11-19)), the CD4+ Jurkat-derived cell line that also expresses exogenous CD8 (CD8), or the CD4+ Jurkat-derived cell line that also expresses exogenous CD8 and various E7(11-19)-specific TCRs (CD8+ TCR-E7(11-19)). Specifically, results are shown for the modified version of TCR 7 and the modified version of TCR 12.
Figure 3B:
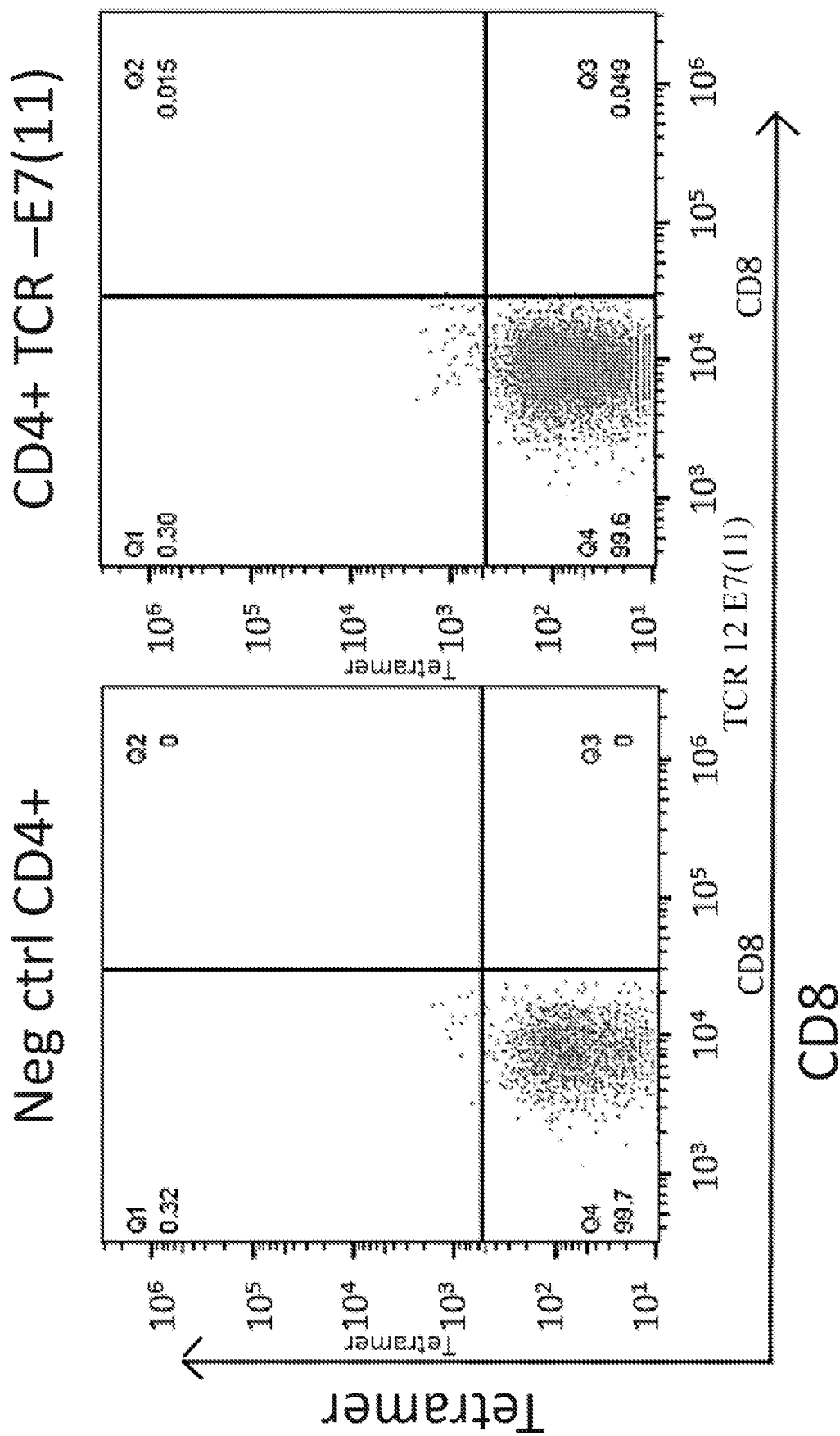
Figure 3C:
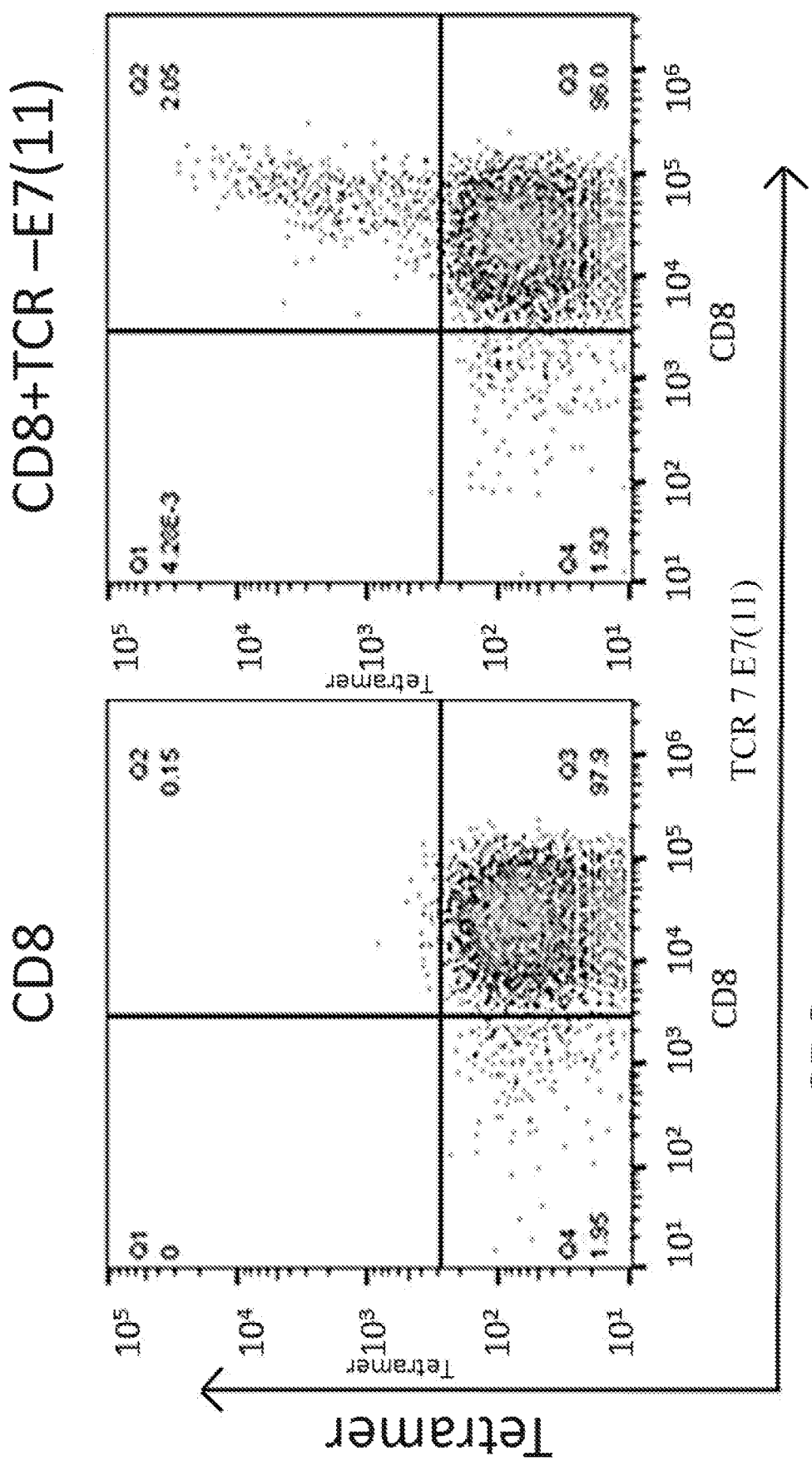
Figure 3D:
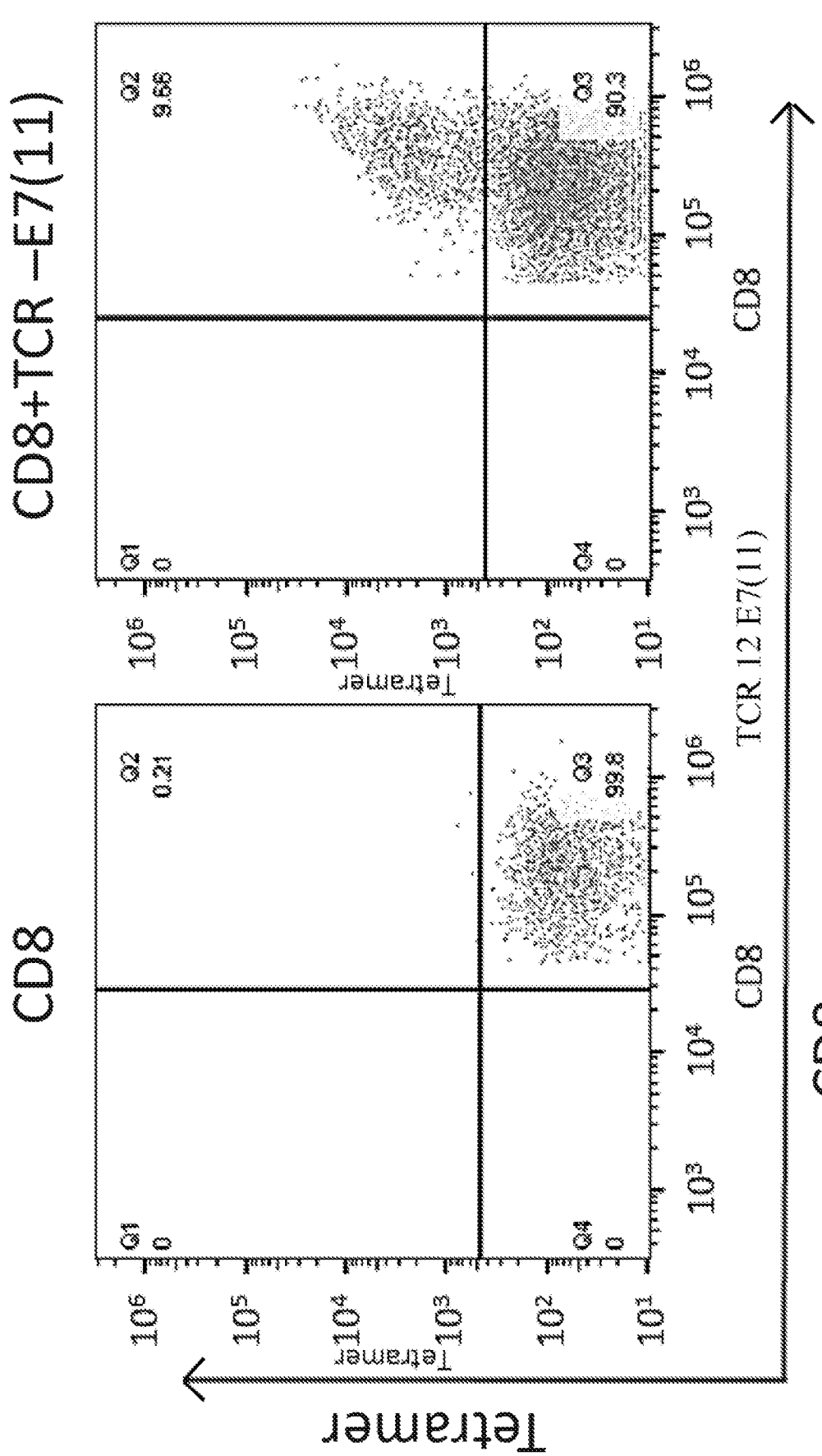

In an exemplary assay, monoclonal cell lines expressing the TCRs were incubated with the CaSki target cells (ATCC No. CRL-1550, containing approximately 600 copies of integrated HPV16) at various effector:target (E:T) ratios. Lytic activity was assessed by measuring caspase in the target cells and assessing the percentage of such cells that were positive to caspase at various time-points following initiation of incubation with the T cells, over 50 hours. Negative controls included incubation of T cells with SiHa cells (ATCC No. HTB-35, essentially negative for the endogenous target antigen, having no more than approximately one or two copies of integrated HPV16 genome) and Caski cells not incubated with T cell clones. The results for two exemplary clonal T cell lines are shown in FIG. 1. As shown, the monoclonal T cell lines were observed to exhibit lytic activity against cells presenting the subject HPV16-derived peptide in the context of HLA-A02:01. A number of CD8+ clones were generated and confirmed to exhibit antigen-specific binding and functionality by this process.

The ability of T cells of clonal lines to specifically bind to peptide epitopes independently of the CD8 co-receptor was assessed using a mutant MHC class I tetramer containing a D227K mutation in its CD8 binding site, rendering it unable to engage the CD8 co-receptor on T cells. See Kerry et al. J Immunol (2003) 171:4493-4503; Kerry et al. Immunology (2005) 114: 44-52. Table 24 lists exemplary TCRs expressed by exemplary clonal cell lines generated by this method. Each of these cell lines was observed in this study to bind the indicated peptide-MHC complex in an antigen-specific manner, as indicated by tetramer staining in comparison to control. Additionally, the indicated clonal lines were observed to specifically bind the relevant peptide in the context of the mutant (non-CD8 interacting) tetramers, indicating the ability of the TCRs expressed by these clonal lines to specifically bind to cognate antigen independently of CD8.

B. Cloning of TCRs Expressed by Clonal Cell Lines

Polynucleotides having sequences encoding the polypeptide chains of TCRs from clonal lines generated as described above were amplified from T cell lines and sequenced using 5' rapid amplification of cDNA ends (RACE). Table 24 provides the sequence identifier (SEQ ID NO) for the alpha and beta chain nucleotide and amino acid sequences, respectively, for a plurality of TCRs generated by this process. Table 24 also lists the SEQ ID NO corresponding to an exemplary full-length encoded amino acid sequence containing the beta and alpha chain sequences of each respective TCR, separated by a ribosome-skip P2A sequence (P2A linker set forth in SEQ ID NO: 204, which may be encoded by a sequence of nucleotides set forth in any of SEQ ID NOs: 4, 5, 6, 207-210) (designated "beta-P2A-alpha"). A nucleotide sequence encoding such a full-length sequence for each of a number of TCRs was inserted into a vector for transfer into a host cell, such as a primary human cell, e.g., a T cell, as described below. Following translation of the nucleotide sequence and self-cleavage of the P2A sequence separating the TCR chains, the recombinant alpha and beta chain of the TCR were exogenously expressed in host cells, such as a primary T cell, for example a primary human T cell. The Table 24 also lists the specific Valpha and Vbeta usage for each cloned TCR.

TABLE 24

Amino Acid and Nucleotide Sequences of HPV-Specific TCRs

| TCR | Epitope | Binding to Peptide in Complex with Mutant (non-CD8-binding) MHC tetramers by Clonal Line | Valpha Usage | Vbeta Usage | Full-length beta-P2A-alpha aa | alpha nt | alpha aa | beta nt | beta aa |
|---|---|---|---|---|---|---|---|---|---|
| TCR 3 | E6(29-38) | Yes | TRAV14/DV4*02 | TRBV7-8*01 | 223 | 20 | 18 | 24 | 22 |
| TCR 4 | E6(29-38) | Yes | TRAV26-2*01 | TRBV7-9*03 | 224 | 30 | 28 | 34 | 32 |
| TCR 5 | E6(29-38) | No | TRAV14/DV4*02 | TRBV28*01 | 225 | 40 | 38 | 44 | 42 |
| TCR 7 | E7(11-19) | No | TRAV10*01 | TRBV2*01 | 227 | 60 | 58 | 64 | 62 |
| TCR 8 | E6(29-38) | No | TRAV21*02 | TRBV28*01 | 228 | 70 | 68 | 74 | 72 |
| TCR 9 | E6(29-38) | Yes | TRAV14/DV4*01 | TRBV6-2*01 | 229 | 80 | 78 | 84 | 82 |
| TCR 10 | E6(29-38) | Yes | TRAV12-1*01 | TRBV28*01 | 230 | 90 | 88 | 94 | 92 |
| TCR 11 | E7(86-93) | No | TRAV26-2*01 | TRBV29-1*01 | 231 | 100 | 98 | 104 | 102 |
| TCR 12 | E7(11-19) | Yes | | TRBV2*01 | 340 | 183 | 283 | 108 | 52, 285 |
| TCR 13 | E6(29-38) | Yes | TRAV8-2 | TRBV10-3 | 341 | 202 | 287 | 17 | 289 |
| TCR 14 | E6(29-38) | | TRAV24 | TRBV28 | 342 | 219 | 291 | 16 | 293 |

C. Codon Optimization, Modification and Lentiviral Expression

Nucleotide sequences encoding TCRs generated as described above were modified by codon optimization and/or by mutation(s) to promote the formation of a non-native disulfide bond in the interface between the TCR constant domains to increase pairing and stability of the TCR. The non-native disulfide bond was promoted by modifying the TCR chains at residue 48 in the Cα region from Thr to Cys and residue 57 of the Cβ region from Ser to Cys (see Kuball et al. (2007) Blood, 109:2331-2338). The corresponding SEQ ID NO for the resulting modified nucleotide sequences and corresponding encoded amino acid sequences for the modified version of each TCR are shown in Table 25.

For individual TCRs modified as described above, constructs were generated that contained the modified nucleotide sequences encoding the beta chain and alpha chain, respectively, of the cloned TCRs, separated by a sequence encoding a P2A polypeptide were generated and inserted into a lentiviral vector, which were used to transduce T cell lines and primary human T cells using standard methods, to express the encoded TCR chains.

TABLE 25

Codon Optimized, Cysteine Modified Version of the TCRs

| TCR | Epitope | Full-length nt | alpha nt | alpha aa | beta nt | beta aa |
|---|---|---|---|---|---|---|
| TCR 3 | E6(29-38) | 26 | 21 | 19 | 25 | 23 |
| TCR 4 | E6(29-38) | 36 | 31 | 29 | 35 | 33 |
| TCR 5 | E6(29-38) | 46 | 41 | 39 | 45 | 43 |
| TCR 6 | E7(11-19) | 56 | 51 | 49 | 54 | 53, 286 |
| TCR 7 | E7(11-19) | 66 | 61 | 59 | 65 | 63 |
| TCR 8 | E6(29-38) | 76 | 71 | 69 | 75 | 73 |
| TCR 9 | E6(29-38) | 86 | 81 | 79 | 85 | 83 |
| TCR 10 | E6(29-38) | 96 | 91 | 89 | 95 | 93 |
| TCR 11 | E7(86-93) | 106 | 101 | 99 | 105 | 103 |
| TCR 12 | E7(11-19) | 15 | 12 | 284 | 9 | 53, 286 |
| TCR 13 | E6(29-38) | 14 | 11 | 288 | 8 | 290 |
| TCR 14 | E6(29-38) | 13 | 10 | 292 | 7 | 294 |

Example 2: Expression and Antigen-Binding of Exemplary TCRs in Jurkat Cells

Exemplary E6-specific and E7-specific T cell receptors (TCRs), generated as described above, were assessed for surface expression on T cells and antigen-specific binding with or without CD8 interaction. Specifically, cells derived from the Jurkat human T cell line that did not express the endogenous TCR on their surfaces (CD4+ Jurkat-derived cells), with or without exogenously expressed CD8, referred to in FIG. 2A-2L, FIG. 3A-3D AND FIG. 4A-4B, as CD8+ and CD4+, respectively, were engineered to express the modified version of the TCRs. For each TCR assessed in this process, the Jurkat-derived cells were transduced with a lentiviral vector particle generated as described above encoding the particular modified version of the TCR. Cells (those containing or not containing exogenous CD8) not transduced with a TCR were used as controls. At day 6 post-transduction with the sequence encoding each TCR, TCR expression and functional activity were assessed by flow cytometry, following staining with labeled tetramers complexed with the respective E6- or E7-peptide (either HLA-A2/E6 (29-38), HLA-A2/E7 (11-19) or HLA-A2/E7 (86-93) tetramer). A reference TCR capable of binding to HLA-A2/E6 (29-38) also was assessed in this study (described in International PCT Publication No. and WO 2015/009606). The reference TCR contains a mouse constant region.

Figure 4A:
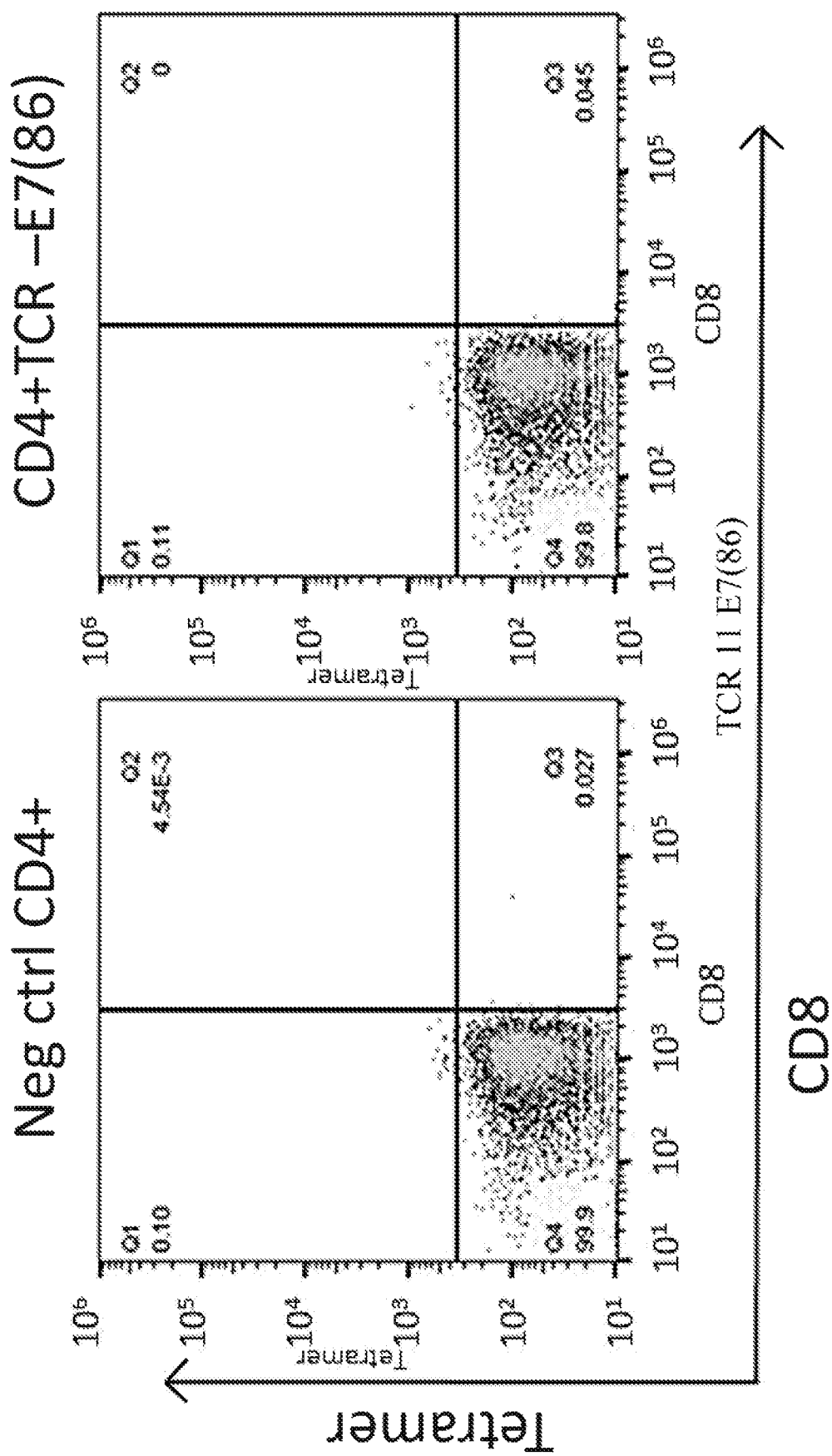
FIG. 4A-4B shows flow cytometry results for tetramer binding by CD4+ Jurkat-derived cell line (Neg ctrl CD4+), the CD4+ Jurkat-derived cell line expressing various E7(86-93)-specific TCRs (CD4+ TCR-E7(86-93)), the CD4+ Jurkat-derived cell line that also expresses exogenous CD8 (CD8), or the CD4+ Jurkat-derived cell line that also expresses exogenous CD8 and various E7(86-93)-specific TCRs (CD8+ TCR-E7(86-93)). Specifically, results are shown for the modified version of TCR 11.
Figure 4B:
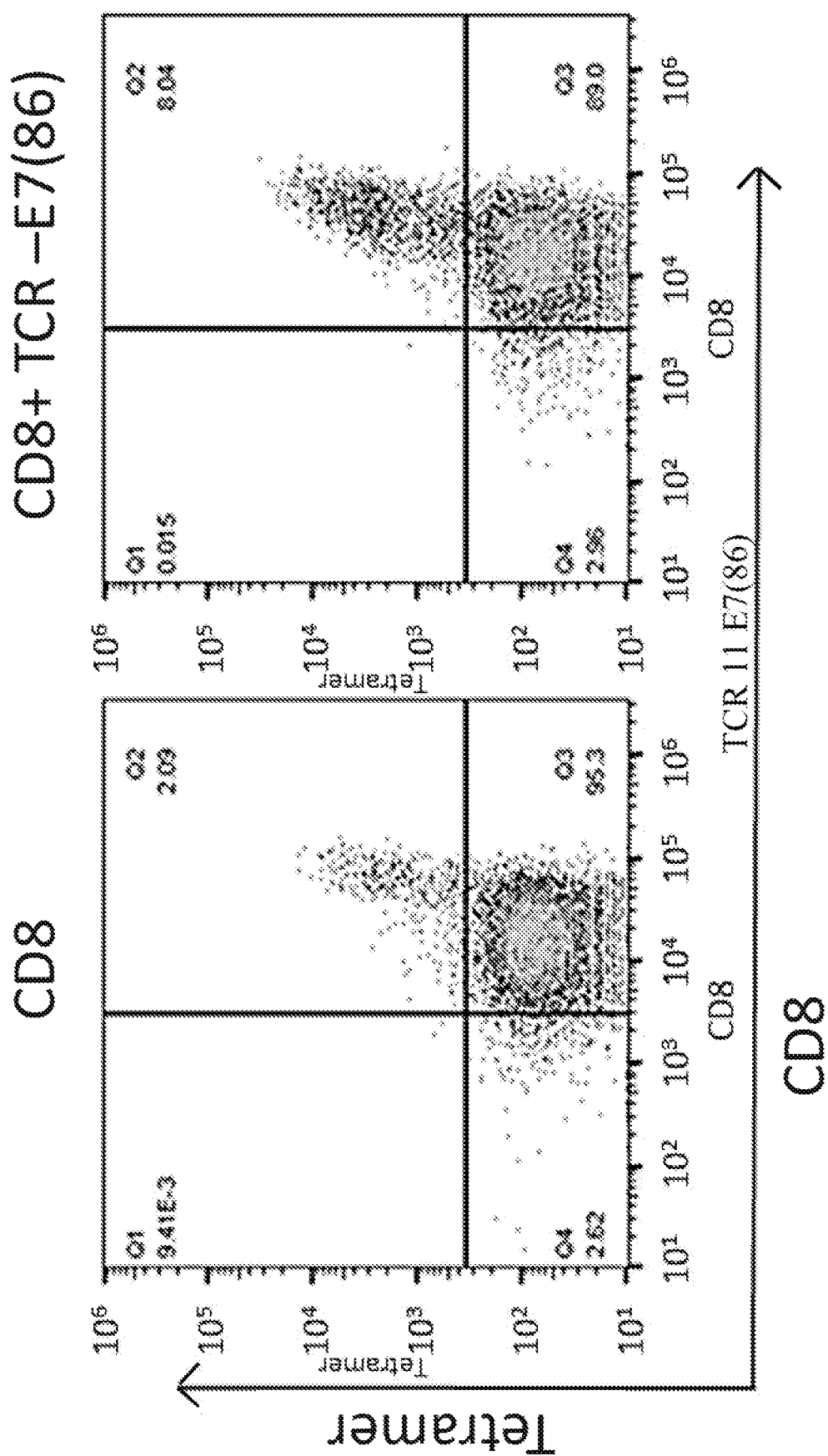

Exemplary results are shown in FIG. 2A-2L (E6(29-38)-loaded tetramer binding), FIG. 3A-3D (E7 (11-19)-loaded tetramer binding) and FIG. 4A-4B (E7(86-93)-loaded tetramer binding). The percentage of cells in the indicated quadrants in flow cytometry plots shown in FIGS. 2A-2L, 3A-3D and 4A-4B are also summarized below in Table 26A (FIG. 2A-2F), Table 26B (FIG. 2G-2L), Table 26C (FIGS. 3A-3D) and Table 26D (FIG. 4A-4B).

TABLE 26A

Percentage of cells present in each indicated quadrant in Flow Cytometry Plots Shown in FIG. 2A-2F

| TCR/Cells | E6 tet+/CD8− quadrant | E6 tet+/CD8+ quadrant | E6 tet−/CD8+ quadrant | E6 tet−/CD8− quadrant |
|---|---|---|---|---|
| Reference/Neg Ctrl (CD4+) | 0.1 | 4.24E-03 | 0.17 | 99.7 |
| Reference/CD4+ TCR −E6(29) | 7.53 | 8.63E-03 | 0.056 | 92.4 |
| TCR 5/Neg Ctrl (CD4+) | 0.14 | 0 | 0.1 | 99.8 |
| TCR 5/CD4+ TCR −E6(29) | 0.094 | 0 | 0.026 | 99.9 |
| TCR 4/Neg Ctrl (CD4+) | 0.1 | 0 | 0.12 | 99.8 |
| TCR 4/CD4+ TCR −E6(29) | 2.52 | 4.42E-03 | 0.04 | 97.4 |
| Reference/CD8 | 8.73E-03 | 0.27 | 98 | 1.69 |
| Reference/CD8+ TCR −E6(29) | 0.041 | 15.8 | 82.5 | 1.65 |
| TCR 5/CD8 | 8.90E-03 | 0.18 | 97.5 | 2.33 |
| TCR 5/CD8+ TCR −E6(29) | 0.018 | 3.28 | 94.5 | 2.22 |
| TCR 4/CD8 | 0 | 0.26 | 98.1 | 1.6 |
| TCR 4/CD8+ TCR −E6(29) | 0.023 | 24.4 | 73.5 | 2.04 |

TABLE 26B

Percentage of cells present in each indicated quadrant in Flow Cytometry Plots Shown in FIG. 2G-2L

| TCR/Cells | E6 tet+/CD8− quadrant | E6 tet+/CD8+ quadrant | E6 tet−/CD8+ quadrant | E6 tet−/CD8− quadrant |
|---|---|---|---|---|
| Reference/Neg Ctrl (CD4+) | 0.1 | 4.24E-03 | 0.17 | 99.7 |
| Reference/CD4+ TCR −E6(29) | 7.53 | 8.63E-03 | 0.056 | 92.4 |
| TCR 3/Neg Ctrl (CD4+) | 0.15 | 4.29E-03 | 0.1 | 99.7 |
| TCR 3/CD4+ TCR −E6(29) | 8.05 | 0 | 0.022 | 91.9 |
| TCR 8/Neg Ctrl (CD4+) | 0.15 | 0 | 0.11 | 99.7 |
| TCR 8/CD4+ TCR −E6(29) | 0.12 | 0 | 0.044 | 99.8 |
| Reference/CD8 | 8.73E-03 | 0.27 | 98 | 1.69 |
| Reference/CD8+ TCR −E6(29) | 0.041 | 15.8 | 82.5 | 1.65 |
| TCR 3/CD8 | 4.58E-03 | 0.31 | 97.8 | 1.9 |
| TCR 3/CD8+ TCR −E6(29) | 0.083 | 18 | 80 | 1.84 |
| TCR 8/CD8 | 0 | 0.22 | 97.2 | 2.57 |
| TCR 8/CD8+ TCR −E6(29) | 0 | 4.09 | 93.6 | 2.34 |

TABLE 26C

Percentage of cells present in each indicated quadrant in Flow Cytometry Plots Shown in FIG. 3A-3D

| TCR/Cells | E7 tet+/CD8− quadrant | E7 tet+/CD8+ quadrant | E7 tet−/CD8+ quadrant | E7 tet−/CD8− quadrant |
|---|---|---|---|---|
| TCR 7/Neg Ctrl (CD4+) | 0.098 | 0 | 0.29 | 99.6 |
| TCR 7/CD4+ TCR −E7(11) | 0.095 | 4.11E-03 | 0.3 | 99.6 |
| TCR 12/Neg Ctrl (CD4+) | 0.32 | 0 | 0 | 99.7 |
| TCR 12/CD4+ TCR −E7(11) | 0.3 | 0.015 | 0.049 | 99.6 |
| TCR 7/CD8 | 0 | 0.15 | 97.9 | 1.95 |
| TCR 7/CD8+ TCR −E7(11) | 4.28E-03 | 2.05 | 96 | 1.93 |
| TCR 12/CD8 | 0 | 0.21 | 99.8 | 0 |
| TCR 12/CD8+ TCR −E7(11) | 0 | 9.66 | 90.3 | 0 |

TABLE 26D

Percentage of cells present in each indicated quadrant in Flow Cytometry Plots Shown in FIG. 4A-4B

| TCR/Cells | E7 tet+/CD8− quadrant | E7 tet+/CD8+ quadrant | E7 tet−/CD8+ quadrant | E7 tet−/CD8− quadrant |
|---|---|---|---|---|
| TCR 11/Neg Ctrl (CD4+) | 0.1 | 4.54E-03 | 0.027 | 99.9 |
| TCR 11/CD4+ TCR −E7(86) | 0.11 | 0 | 0.045 | 99.8 |
| TCR 11/CD8 | 9.41E-03 | 2.09 | 95.3 | 2.62 |
| TCR 11/CD8+ TCR −E7(86) | 0.015 | 8.04 | 89 | 2.96 |

As shown, TCRs generated by these methods were cloned and observed to be expressed on the surface of T cells and to bind HPV peptide in the context of MHC tetramers, in some cases independently of CD8 co-receptor.

Example 3: Functional Assessment of Cells Transduced with HPV-16 E6 and E7 Epitope-Specific T Cell Receptors Primary CD8+ human T cells were transduced with a lentiviral vector particle generated as described above encoding chains of modified versions of TCRs specific for E6(29-38) in the context of HLA:A2:01, including exemplary modified versions of TCRs TCR 5, TCR 4, TCR 3, TCR 8, TCR 9, TCR 10 and TCR7. Such transduced T cells were assessed for functional activity, including the ability to generate cytokines and exhibit lytic activity in response to cells expressing the peptide: MHC. An exemplary E7(11-19)-specific TCR was used as a negative control in these studies.

A. Cytokine Production

To assess the production of cytokines in response to antigen, the cells were incubated for 4 hours at a 10:1 E:T ratio with T2 cells that had been pulsed overnight with 10)(M of E6(29-38) peptide or, as a control, 10)(M of E7(11-19) peptide. As a positive control, cytokine activity also was assessed in cultures of transduced T cells stimulated with either phorbol myristate acetate (PMA) and Brefeldin A (BFA) or with BFA alone. Intracellular IFNγ was measured in the cultured cells by flow cytometry. The percent of CD8 and intracellular IFNγ positive (% CD8+/IC IFNγ+) cells was determined by flow cytometry.

The results are shown in Table 27. These results confirmed the ability of primary human T cells expressing E6(29-38)-specific TCRs generated by these methods to produce cytokine in response to target cells in an antigen-specific manner.

TABLE 27

Cytokine activity

| Peptide/ Treatment | TCR | % CD8+/IC IFNγ+ |
|---|---|---|
| E6(29-38) | TCR 5 | 43.7 |
| | TCR 7 | 70.5 |
| | TCR 4 | 94.2 |
| | TCR 3 | 95.1 |
| | TCR 8 | 95.0 |
| | TCR 9 | 91.1 |
| | TCR 10 | 98.9 |
| E7(11-19) | TCR 5 | 7.22 |
| | TCR 7 | 62.4 |
| | TCR 4 | 2.5 |
| | TCR 3 | 2.51 |
| | TCR 8 | 11.4 |
| | TCR 9 | 19.5 |
| | TCR 10 | 1.17 |
| T cells + PMA + BFA | TCR 5 | 22.4 |
| | TCR 7 | 89.4 |
| | TCR 4 | 27.9 |
| | TCR 3 | 94.4 |
| | TCR 8 | 98.4 |
| | TCR 9 | 22.3 |
| | TCR 10 | 27.5 |
| T cells + BFA | TCR 5 | 4.83 |
| | TCR 7 | 57.9 |
| | TCR 4 | 1.87 |
| | TCR 3 | 1.82 |
| | TCR 8 | 8.18 |
| | TCR 9 | 11.1 |
| | TCR 10 | 0.63 |

B. Lytic Activity

Lytic activity of the transduced primary human T cells against cells expressing HPV16 was assessed by incubating CaSki cells (in the presence or absence of IFNγ) at a 10:1 E:T ratio. Samples in which SiHa cells were used as the target cells at the same E:T ratio served as a negative control. Lytic activity also was assessed against T2 cells pulsed with peptide E6(29-38). The ability of the T cells to antigen-specifically cause lytic activity was assessed by measuring active-caspase in the target cells 4 hours post co-culture.

Example 4: Screening and Selection of HPV-16 E6 and E7 Epitope-Specific T Cell Receptors from Normal Donors A screening process using autologous dendritic and T cells was performed to generate antigen-specific T cell receptors (TCRs) that specifically bound to human papillomavirus 16 (HPV16) E6(29-38) or E7(11-19) peptide presented on MHC-I molecules and survived and/or were enriched over time, following multiple rounds of antigen-stimulation. Clonal T cell lines were generated and the sequences of individual paired TCR alpha and beta chains and abundance thereof in various populations were determined on a single-cell basis, using high-throughput paired TCR sequencing.

A. Generation and Cloning of Human HPV-Specific T Cells and TCRs

Briefly, peptide-pulsed antigen-presenting cells were generated from PBMCs from human donors substantially as described in Example 1. Specifically, peptide-pulsed HLA:A02:01APCs were generated with HPV 16 E6(29-38) peptide (TIHDIILECV; SEQ ID NO:233) or E7(11-19) peptide (YMLDLQPET; SEQ ID NO:236). Autologous CD8+ T cells from normal human donors were incubated over multiple rounds with the peptide-pulsed cells, and selections were carried out based on binding to peptide-loaded autologous MHC tetramers. Generally, cells were subjected to a total of three rounds of stimulation, in the presence of peptide-pulsed cells (with a peptide concentration of 1000 ng/mL maintained over the three rounds). Following the second and third rounds of stimulation, cells were sorted by flow cytometry into populations positive and negative, respectively, for binding to peptide-MHC tetramers containing the appropriate tetramer. Cells of the tetramer-positive and negative populations following each of the second and third rounds were subjected to single-cell TCR sequencing, to assess the presence and frequency of individual TCRs in the different populations, and the persistence of TCR clones over multiple rounds of antigen stimulation.

B. Determination of TCR Sequences and Assessment of TCRs

Cell populations from the positive and negative fractions (i.e., sorted by flow cytometry based on positive and negative staining, respectively, for binding to the E6(29-38) peptide-loaded, or E7(11-19) peptide-loaded, MHC tetramers, as determined by flow cytometry) following rounds 2 and 3 of stimulation were subject to high-throughput single-cell sequencing for TCR alpha and beta chain pairs. High throughput single cell TCR sequencing was performed as generally described in published PCT patent applications, publication numbers WO2012/048340, WO2012/048341 and WO2016/044227. The sequencing methods employed single-cell droplets and sample and molecular barcodes, to identify individual pairs of TCR alpha and beta chain sequences at a single-cell level, for each of a large number (e.g., millions) of single cells present in a single starting composition, and to assess abundance of each TCR pair in various populations assessed. The ability to identify and quantify TCR pairs at a single-cell level permitted the assessment of the frequency of each of various TCR pairs in each of the individual positive and negative fractions, and to assess enrichment and persistence of TCRs over multiple rounds of antigen stimulation. TCR pairs identified in this assay were selected based on their presence in the peptide-binding fractions following rounds 2 and 3, higher abundance in positive versus negative fractions in each of these rounds, and enrichment over time following multiple rounds of exposure to antigen.

Tables 28 and 29 list exemplary E6(29-38)- and E7(11-19)-specific TCRs isolated according to this method, respectively, and the sequence identifiers (SEQ ID NO:) for the alpha and beta chain nucleotide and amino acid sequences for each TCR. Tables 28 and 29 also list the sequence identifier (SEQ ID NO) corresponding to an exemplary full-length encoded amino acid sequence containing the beta and alpha chain sequences of each respective TCR, separated by a sequence encoding a ribosome-skip P2A sequence (P2A linker set forth in SEQ ID NO: 204) (designated "beta-P2A-alpha"). A nucleotide sequence encoding such a full-length sequence for each of a number of TCRs was inserted into a vector for transfer into a host cell, such as a primary human cell, e.g., a T cell, as described below. Following translation of the nucleotide sequence and self-cleavage of the P2A sequence separating the TCR chains, the recombinant alpha and beta chain of the TCR were exogenously expressed in host cells.

TABLE 28

Amino Acid and Nucleotide Sequences of HPV 16 E6(29-38)-Specific TCRs

| | | SEQ ID NO. | | | | |
|---|---|---|---|---|---|---|
| | | Full length beta-P2A-alpha sequence | alpha | | beta | |
| TCR | Epitope | aa | nt | aa | nt | aa |
| TCR 15 | E6(29-38) | 391 | 389 | 473 | 390 | 479 |
| TCR 16 | E6(29-38) | 392 | 430 | 488 | 431 | 494 |
| TCR 17 | E6(29-38) | 393 | 1019 | 500 | 1020 | 494 |
| TCR 18 | E6(29-38) | 394 | 1021 | 506 | 1022 | 512 |
| TCR 19 | E6(29-38) | 395 | 1023 | 518 | 1024 | 526 |
| TCR 20 | E6(29-38) | 396 | 1025 | 532 | 1026 | 541 |
| TCR 21 | E6(29-38) | 397 | 1027 | 550 | 1028 | 556 |
| TCR 22 | E6(29-38) | 398 | 1029 | 565 | 1030 | 574 |
| TCR 23 | E6(29-38) | 399 | 1031 | 583 | 1032 | 589 |
| TCR 24 | E6(29-38) | 400 | 1033 | 595 | 1034 | 601 |
| TCR 25 | E6(29-38) | 401 | 1035 | 607 | 1036 | 613 |
| TCR 26 | E6(29-38) | 402 | 1037 | 619 | 1038 | 625 |
| TCR 27 | E6(29-38) | 403 | 1039 | 633 | 1040 | 639 |
| TCR 28 | E6(29-38) | 404 | 1041 | 645 | 1042 | 651 |
| TCR 29 | E6(29-38) | 405 | 1043 | 657 | 1044 | 663 |
| TCR 30 | E6(29-38) | 406 | 1045 | 672 | 1046 | 681 |

TABLE 29

Amino Acid and Nucleotide Sequences of HPV 16 E7(11-19)-Specific TCRs

| | | SEQ ID NO. | | | | |
|---|---|---|---|---|---|---|
| | | Full length beta-P2A-alpha sequence | alpha | | beta | |
| TCR | Epitope | aa | nt | aa | nt | aa |
| TCR 31 | E7(11-19) | 407 | 1225 | 687 | 1224 | 696 |
| TCR 32 | E7(11-19) | 408 | 1049 | 705 | 1050 | 714 |
| TCR 33 | E7(11-19) | 409 | 1051 | 722 | 1052 | 731 |
| TCR 34 | E7(11-19) | 410 | 1226 | 737 | 1227 | 746 |
| TCR 35 | E7(11-19) | 411 | 1055 | 755 | 1056 | 764 |
| TCR 36 | E7(11-19) | 412 | 1057 | 771 | 1058 | 777 |
| TCR 37 | E7(11-19) | 413 | 1059 | 783 | 1060 | 789 |
| TCR 38 | E7(11-19) | 414 | 1061 | 795 | 1062 | 804 |
| TCR 39 | E7(11-19) | 415 | 1063 | 811 | 1064 | 820 |
| TCR 40 | E7(11-19) | 416 | 1065 | 826 | 1066 | 835 |
| TCR 41 | E7(11-19) | 417 | 1067 | 841 | 1068 | 847 |
| TCR 42 | E7(11-19) | 418 | 1069 | 853 | 1070 | 859 |
| TCR 43 | E7(11-19) | 419 | 1071 | 865 | 1072 | 871 |
| TCR 44 | E7(11-19) | 420 | 1073 | 877 | 1074 | 883 |
| TCR 45 | E7(11-19) | 421 | 1075 | 891 | 1076 | 897 |
| TCR 46 | E7(11-19) | 422 | 1077 | 904 | 1078 | 913 |
| TCR 47 | E7(11-19) | 423 | 1079 | 921 | 1080 | 927 |
| TCR 48 | E7(11-19) | 424 | 1081 | 933 | 1082 | 941 |
| TCR 49 | E7(11-19) | 425 | 1083 | 947 | 1084 | 953 |
| TCR 50 | E7(11-19) | 426 | 1085 | 959 | 1086 | 965 |
| TCR 51 | E7(11-19) | 427 | 1087 | 971 | 1088 | 977 |
| TCR 52 | E7(11-19) | 428 | 1089 | 983 | 1090 | 989 |
| TCR 53 | E7(11-19) | 429 | 1091 | 995 | 1092 | 1004 |
| TCR 54 | E7(11-19) | 227 | 1093 | 58 | 1094 | 62 |
| TCR 55 | E7(11-19) | 340 | 1095 | 283 | 1228 | 285 |
| TCR 66 | E7(11-19) | 1383 | | 1386 | | 1376 |

C. Codon Optimization and Modification

Nucleotide sequences encoding TCRs generated as described above were modified by codon optimization and/or by mutation(s) to promote the formation of a non-native disulfide bond in the interface between the TCR constant domains to increase pairing and stability of the TCR. The non-native disulfide bond was promoted by modifying the TCR chains at residue 48 in the Cα region from Thr to Cys and residue 57 of the Cβ region from Ser to Cys (see Kuball et al. (2007) Blood, 109:2331-2338). The corresponding SEQ ID NO for the resulting modified nucleotide sequences and corresponding encoded amino acid sequences for the modified version of each TCR are shown in Table 30 (E6(29-38)-specific TCR) and Table 31 (E7(11-19)-specific TCRs).

For individual TCRs modified as described above, constructs were generated that contained the modified nucleotide sequences encoding the beta chain and alpha chain, respectively, of the cloned TCRs, separated by a sequence encoding a P2A polypeptide and inserted into a vector, e.g. lentiviral vector, which were used for expressing the TCR chain in T cell lines and primary human T cells using standard methods.

TABLE 30

Codon Optimized, Cysteine Modified Version of HPV 16 E6(29-38)-Specific TCRs

| | | SEQ ID NO. of Modified Version of TCR | | | | |
|---|---|---|---|---|---|---|
| | | Full-length | alpha | | beta | |
| TCR | Epitope | nt | nt | aa | nt | aa |
| TCR 15 | E6(29-38) | 432 | 1097 | 474 | 1098 | 480 |
| TCR 16 | E6(29-38) | 433 | 1099 | 489 | 1100 | 495 |
| TCR 17 | E6(29-38) | 434 | 1101 | 501 | 1102 | 495 |
| TCR 18 | E6(29-38) | 435 | 1103 | 507 | 1104 | 513 |
| TCR 19 | E6(29-38) | 436 | 1105 | 519 | 1106 | 527 |
| TCR 20 | E6(29-38) | 437 | 1107 | 533 | 1108 | 542 |
| TCR 21 | E6(29-38) | 438 | 1109 | 551 | 1110 | 557 |
| TCR 22 | E6(29-38) | 439 | 1111 | 566 | 1112 | 575 |
| TCR 23 | E6(29-38) | 440 | 1113 | 584 | 1114 | 590 |
| TCR 24 | E6(29-38) | 441 | 1115 | 596 | 1116 | 602 |
| TCR 25 | E6(29-38) | 442 | 1117 | 608 | 1118 | 614 |
| TCR 26 | E6(29-38) | 443 | 1119 | 620 | 1120 | 626 |
| TCR 27 | E6(29-38) | 444 | 1121 | 634 | 1122 | 640 |
| TCR 28 | E6(29-38) | 445 | 1123 | 646 | 1124 | 652 |
| TCR 29 | E6(29-38) | 446 | 1125 | 658 | 1126 | 664 |
| TCR 30 | E6(29-38) | 447 | 1127 | 673 | 1128 | 682 |

TABLE 31

Codon Optimized, Cysteine Modified Version of HPV 16 E7(11-19)-Specific TCRs

| TCR | Epitope | Full-length nt | alpha nt | alpha aa | beta nt | beta aa |
|---|---|---|---|---|---|---|
| TCR 31 | E7(11-19) | 448 | 1129 | 688 | 1130 | 697 |
| TCR 32 | E7(11-19) | 449 | 1131 | 706 | 1132 | 715 |
| TCR 33 | E7(11-19) | 450 | 1133 | 723 | 1134 | 732 |
| TCR 34 | E7(11-19) | 451 | 1135 | 738 | 1136 | 747 |
| TCR 35 | E7(11-19) | 452 | 1137 | 756 | 1138 | 765 |
| TCR 36 | E7(11-19) | 453 | 1139 | 772 | 1140 | 778 |
| TCR 37 | E7(11-19) | 454 | 1141 | 784 | 1142 | 790 |
| TCR 38 | E7(11-19) | 455 | 1143 | 796 | 1144 | 805 |
| TCR 39 | E7(11-19) | 456 | 1145 | 812 | 1146 | 821 |
| TCR 40 | E7(11-19) | 457 | 1147 | 827 | 1148 | 836 |
| TCR 41 | E7(11-19) | 458 | 1149 | 842 | 1150 | 848 |
| TCR 42 | E7(11-19) | 459 | 1151 | 854 | 1152 | 860 |
| TCR 43 | E7(11-19) | 460 | 1153 | 866 | 1154 | 872 |
| TCR 44 | E7(11-19) | 461 | 1155 | 878 | 1156 | 884 |
| TCR 45 | E7(11-19) | 462 | 1157 | 892 | 1158 | 898 |
| TCR 46 | E7(11-19) | 463 | 1159 | 905 | 1160 | 914 |
| TCR 47 | E7(11-19) | 464 | 1161 | 922 | 1162 | 928 |
| TCR 48 | E7(11-19) | 465 | 1163 | 934 | 1164 | 942 |
| TCR 49 | E7(11-19) | 466 | 1165 | 948 | 1166 | 954 |
| TCR 50 | E7(11-19) | 467 | 1167 | 960 | 1168 | 966 |
| TCR 51 | E7(11-19) | 468 | 1169 | 972 | 1170 | 978 |
| TCR 52 | E7(11-19) | 469 | 1171 | 984 | 1172 | 990 |
| TCR 53 | E7(11-19) | 470 | 1173 | 996 | 1174 | 1005 |
| TCR 54 | E7(11-19) | 471 | 1175 | 59 | 1176 | 63 |
| TCR 55 | E7(11-19) | 472 | 1177 | 284 | 1178 | 286 |
| TCR 66 | E7(11-19) | 1382 | 1385 | 1387 | 1375 | 1377 |

Example 5: Expression and Antigen-Binding of Exemplary E6- and E7-Specific TCRs Exemplary E6- and E7-specific T cell receptors (TCRs), identified as described in Example 4 above that were codon-optimized and cysteine-modified, were expressed in T cells and assessed for surface expression and antigen-specific binding, with or without CD8 interaction substantially as described in Example 2 above. Specifically, CD4+ Jurkat-derived cells that did not express endogenous TCR on their surfaces, that either had or had not been modified by introduction of exogenous CD8 (modification resulting in CD4+/CD8+ cells), were mixed in a 1:1 mixture for transfection with plasmid DNA encoding the TCRs, to assess CD8-independent binding activity of the TCRs. For transfection, the CD4+ and CD4+/CD8+ cell mixtures were transiently transfected with TCR-encoding plasmids and 48 hours after transfection, cells were assessed by flow cytometry for (1) binding of the target peptide in the context of an MHC molecule (HLA:A02:01) by staining with an E6(29-38) peptide- or an E7(11-19) peptide-MHC tetramer reagent, and/or (2) CD8+ independent binding of the target by co-staining the tetramer-labeled cells with an anti-CD8 antibody. Cells that had been mock transfected (mock) and cells expressing a reference TCR capable of binding to HLA-A2/E6(29-38) also were assessed in this study.

Figure 5A:
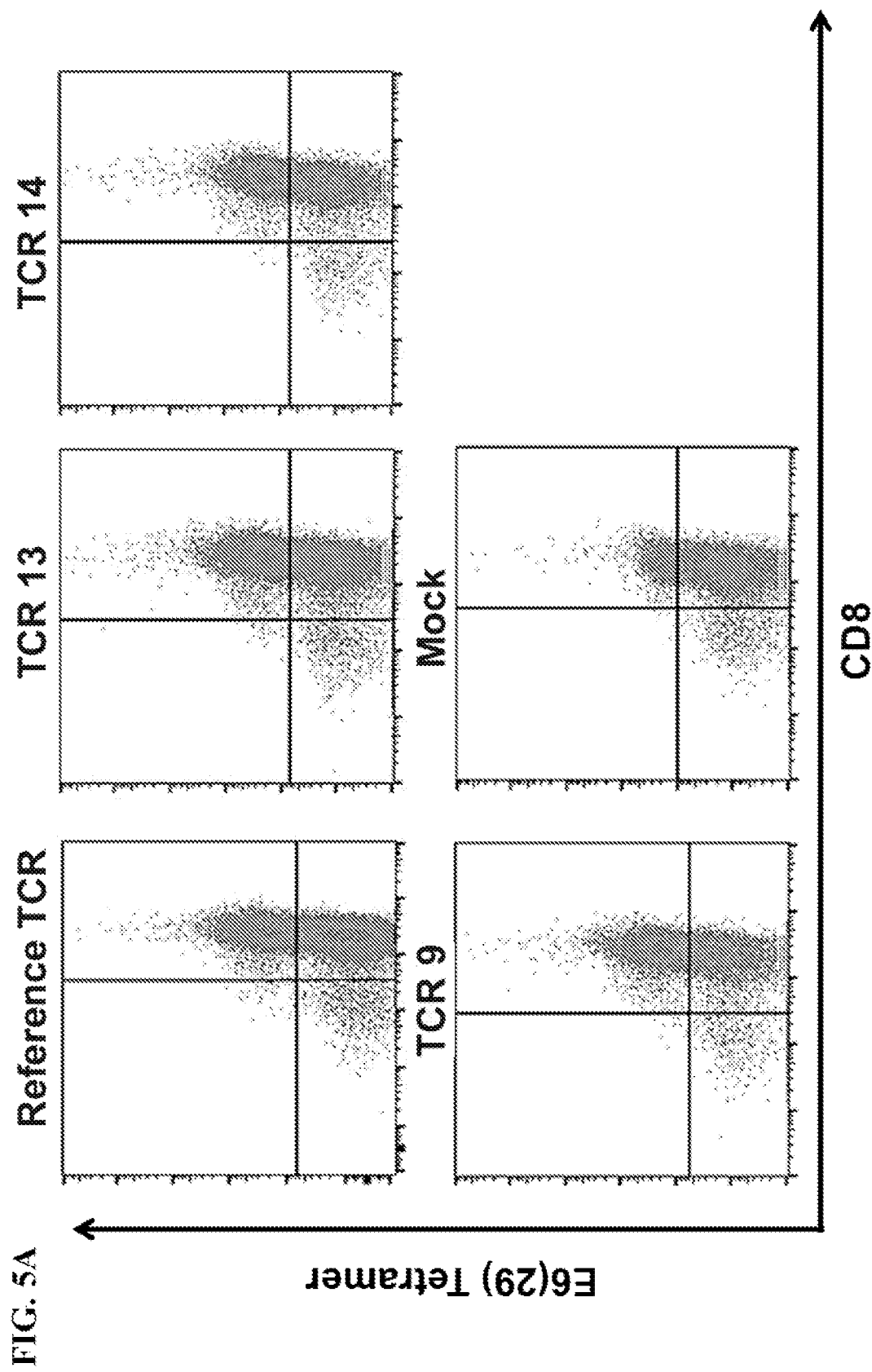
Figure 5C:
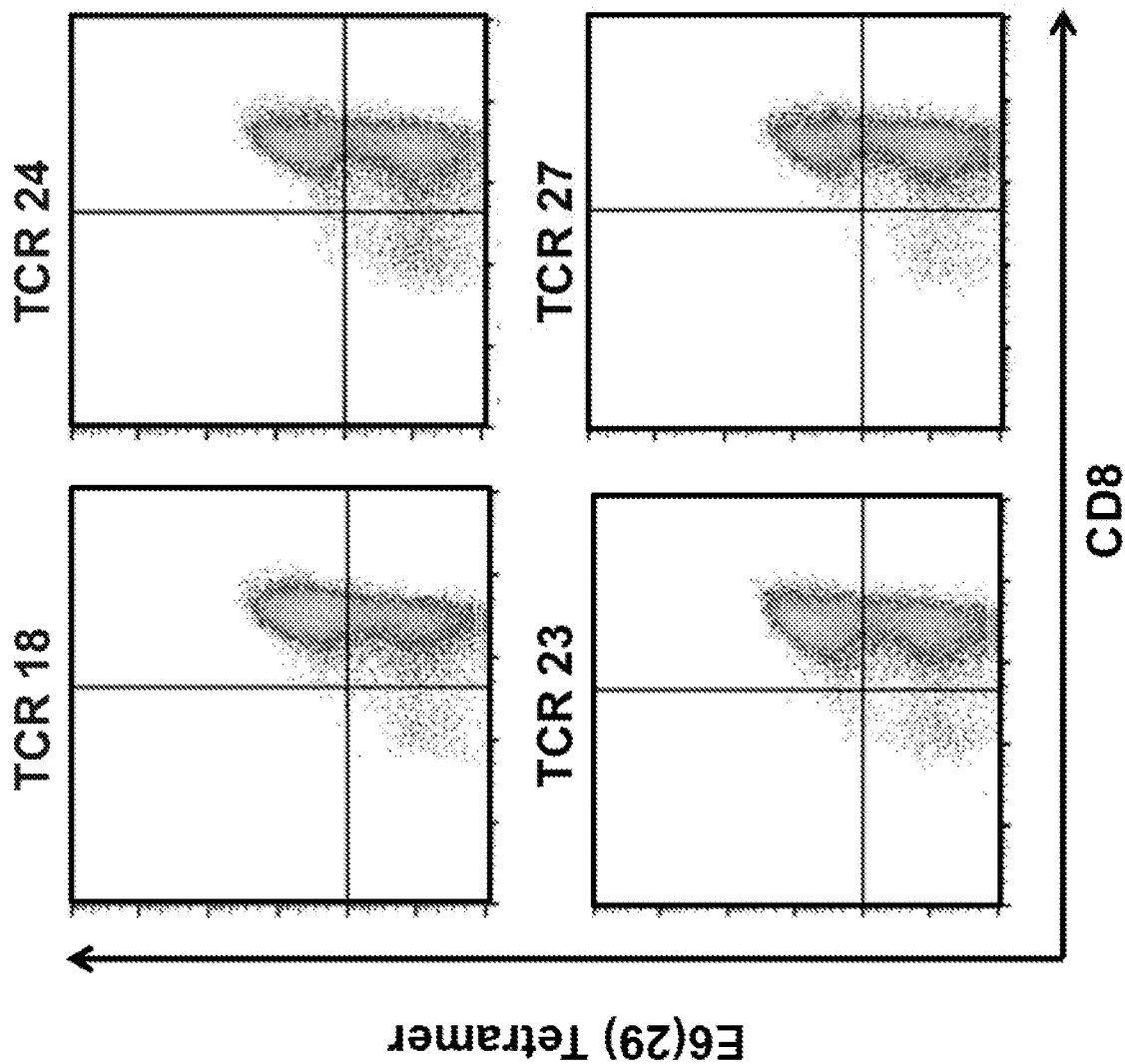
Figure 5E:
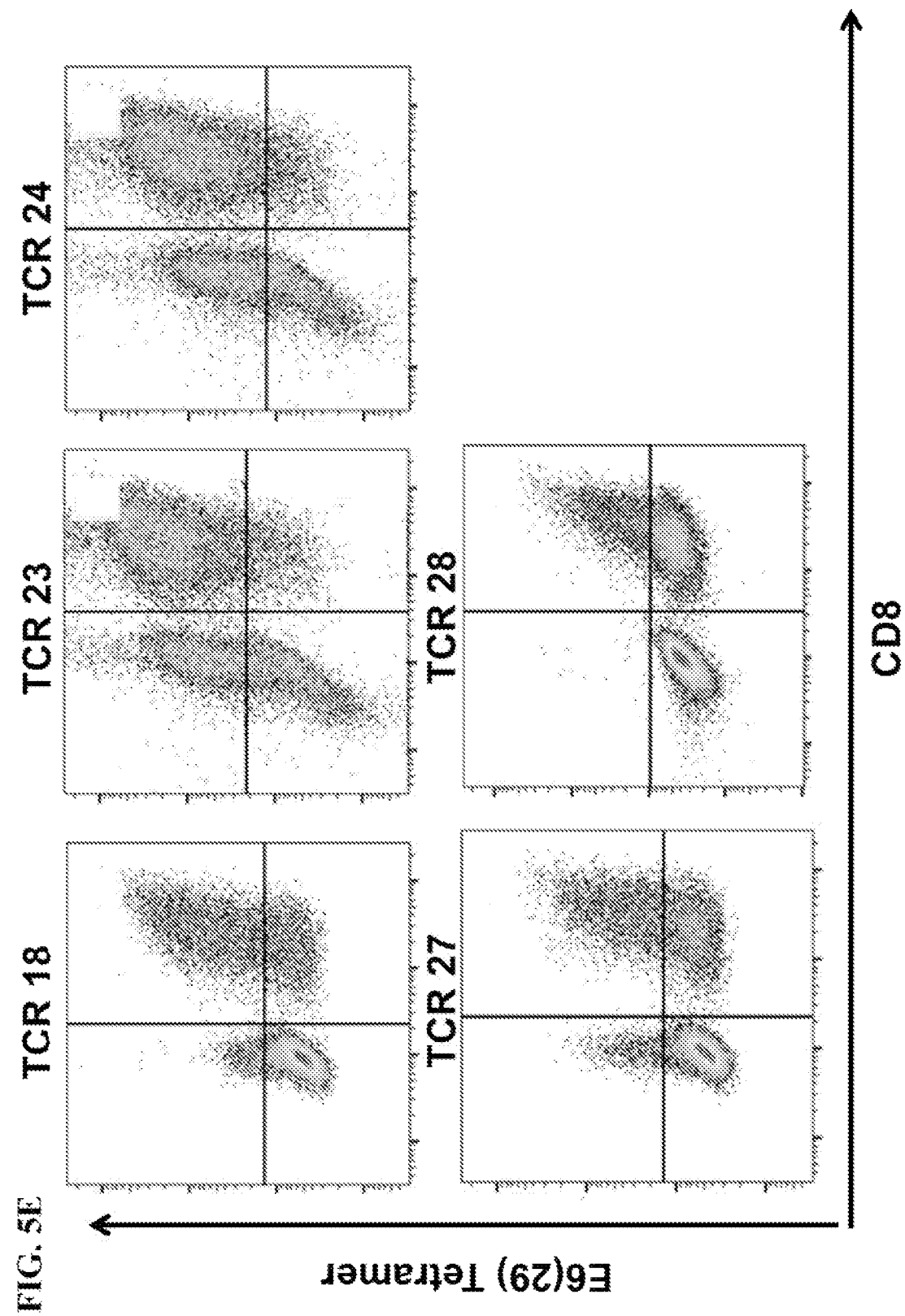
Figure 5F:
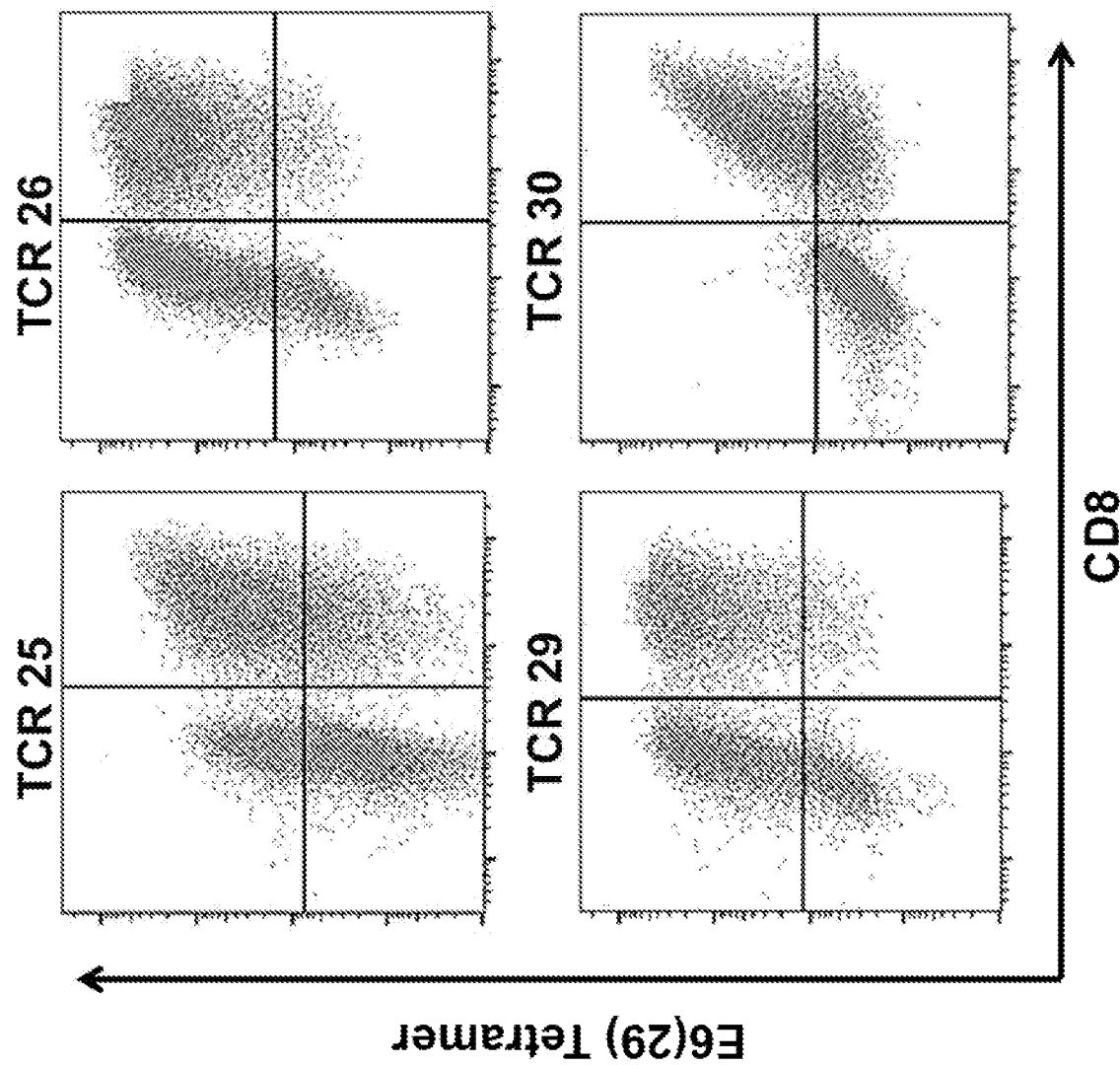

Exemplary results are shown in FIGS. 5A-5F (E6(29-38)-loaded tetramer binding) and FIGS. 6A-6F (E7 (11-19)-loaded tetramer binding). The percentage of cells in the indicated quadrants in flow cytometry plots shown in FIGS. 5A-5I and 6A-6I are also summarized below in Table 32 (flow cytometry plots showing E6(29) tetramer and CD8+ staining results for CD8+ cells from TCR-transfected compositions; FIGS. 5A-5C), Table 33 (flow cytometry plots showing results for E6(29)-specific TCR-transfected cell compositions; FIGS. 5D-5F) and Table 34 (flow cytometry plots showing results for E7(11)-specific TCRs; FIG. 6A-6F). Specifically, FIGS. 5A-5C depict flow cytometry plots for tetramer and CD8 staining in CD8+ populations; FIGS. 5D-5F and 6A-6F depict plots reflecting staining of CD8+ and CD8-populations.

TABLE 32

Percentage of cells present in each indicated quadrant in Flow Cytometry Plots Shown in FIGS. 5A-5C

| E6 TCRs | E6 tet+/CD8− quadrant | E6 tet+/CD8+ quadrant | E6 tet−/CD8+ quadrant | E6 tet−/CD8− quadrant |
|---|---|---|---|---|
| Mock | 0.046 | 12.5 | 83.7 | 3.75 |
| Reference TCR | 0.07 | 32 | 65.9 | 1.95 |
| TCR 9 | 0.051 | 42.5 | 55.6 | 1.89 |
| TCR 13 | 0.064 | 38.6 | 59.5 | 1.82 |
| TCR 14 | 0.04 | 38.4 | 59.7 | 1.8 |
| Mock | 5.85E-03 | 4.44 | 88.9 | 6.64 |
| Reference TCR | 0.16 | 40 | 57.9 | 1.93 |
| TCR 17 | 0.17 | 34.7 | 63.6 | 1.53 |
| TCR 18 | 0.045 | 50.4 | 47.7 | 1.86 |
| TCR 21 | 0.22 | 51.6 | 46 | 2.18 |
| TCR 22 | 0.14 | 51.2 | 47.3 | 1.38 |
| TCR 23 | 0.18 | 43.6 | 54.1 | 2.14 |
| TCR 24 | 0.13 | 29.1 | 66.2 | 4.51 |
| TCR 27 | 0.02 | 24.5 | 73.5 | 1.96 |

TABLE 33

Percentage of cells present in each indicated quadrant in flow cytometry plots in FIGS. 5D-5F

| E6 TCRs | E6 tet+/−<br>CD8<br>quadrant | E6 tet+/<br>CD8+<br>quadrant | E6 tet−/<br>CD8+<br>quadrant | E6 tet−/<br>CD8−<br>quadrant |
|---|---|---|---|---|
| TCR 15 | 40.2 | 21.4 | 13.6 | 24.8 |
| TCR 16 | 28.2 | 35.6 | 9.51 | 26.7 |
| TCR 17 | 21.3 | 36.2 | 7.72 | 34.8 |
| TCR 18 | 3.61 | 23.3 | 12 | 61.1 |
| TCR 19 | 20.8 | 35.5 | 7.71 | 36 |
| TCR 20 | 34.1 | 38.2 | 5.17 | 22.6 |
| TCR 21 | 32.7 | 28.8 | 7.16 | 31.3 |
| TCR 23 | 22.5 | 52.5 | 5.19 | 19.7 |
| TCR 24 | 23.5 | 55 | 5.56 | 16 |
| TCR 25 | 14.7 | 34 | 10.2 | 41.1 |
| TCR 26 | 47.4 | 42.3 | 1.58 | 8.73 |
| TCR 27 | 3.5 | 15.8 | 20.1 | 60.6 |
| TCR 28 | 0.15 | 13.1 | 31.4 | 55.4 |
| TCR 29 | 44.5 | 35.6 | 2 | 17.9 |
| TCR 30 | 0.74 | 31 | 13.9 | 54.3 |

TABLE 34

Percentage of cells identified in each indicated quadrant in flow cytometry plots in FIGS. 6A-6F

| E7 TCRs | E7 tet+/<br>CD8−<br>quadrant | E7 tet+/<br>CD8+<br>quadrant | E7 tet−/<br>CD8+<br>quadrant | E7 tet−/<br>CD8−<br>quadrant |
|---|---|---|---|---|
| Mock | 0.01 | 0.1 | 96.1 | 3.77 |
| TCR 12 | 8.48E-03 | 1.89 | 96.2 | 1.86 |
| TCR 12 | 0.001 | 18.6 | 78.6 | 2.82 |
| TCR 31 | 0.042 | 4.52 | 21.1 | 74.3 |
| TCR 32 | 33.5 | 25.3 | 7.53 | 33.7 |
| TCR 33 | 14 | 22.6 | 12.8 | 50.6 |
| TCR 34 | 26 | 26.3 | 6.85 | 40.9 |
| TCR 35 | 7.18 | 14.5 | 35.1 | 43.2 |
| TCR 36 | 16.7 | 23.4 | 25.4 | 34.5 |
| TCR 37 | 19.5 | 25.5 | 22.7 | 32.2 |
| TCR 38 | 5.44 | 15.7 | 33.3 | 45.5 |
| TCR 39 | 2.61 | 12.3 | 37 | 48 |
| TCR 40 | 1.37 | 7.84 | 42.4 | 48.4 |
| TCR 41 | 2.41 | 6.07 | 43.6 | 47.9 |
| TCR 42 | 1.65 | 1.21 | 39.5 | 57.4 |
| TCR 43 | 1.88 | 3.82 | 37.6 | 56.7 |
| TCR 44 | 1.43 | 2.96 | 39.9 | 55.7 |
| TCR 45 | 16.9 | 22.4 | 19.5 | 41.3 |
| TCR 46 | 1.21 | 1.27 | 38.9 | 58.6 |
| TCR 47 | 0.71 | 1.98 | 40.6 | 56.7 |
| TCR 48 | 1.29 | 5.36 | 37 | 56.4 |
| TCR 49 | 3.06 | 5.54 | 27.2 | 64.3 |
| TCR 50 | 0.25 | 3.28 | 30.7 | 65.8 |
| TCR 51 | 2.06 | 5.7 | 27.5 | 64.7 |
| TCR 53 | 0.43 | 3.35 | 28.7 | 67.5 |
| TCR 54 | 11.3 | 9.66 | 21.2 | 57.6 |
| TCR 54 | 0.63 | 2.75 | 48.3 | 48.3 |
| TCR 55 | 0.28 | 1.45 | 50.4 | 47.9 |

As shown, the exemplary assessed TCRs were expressed on the surface of T cells and recognized HPV peptide in the context of MHC tetramers. In some cases, the binding was independent of CD8 co-receptor, as indicated by tetramer+ cells in the CD8− population in FIGS. 5D-5F (percentages listed in Table 33) and FIGS. 6A-6F (percentages listed in Table 34).

Figure 6B:
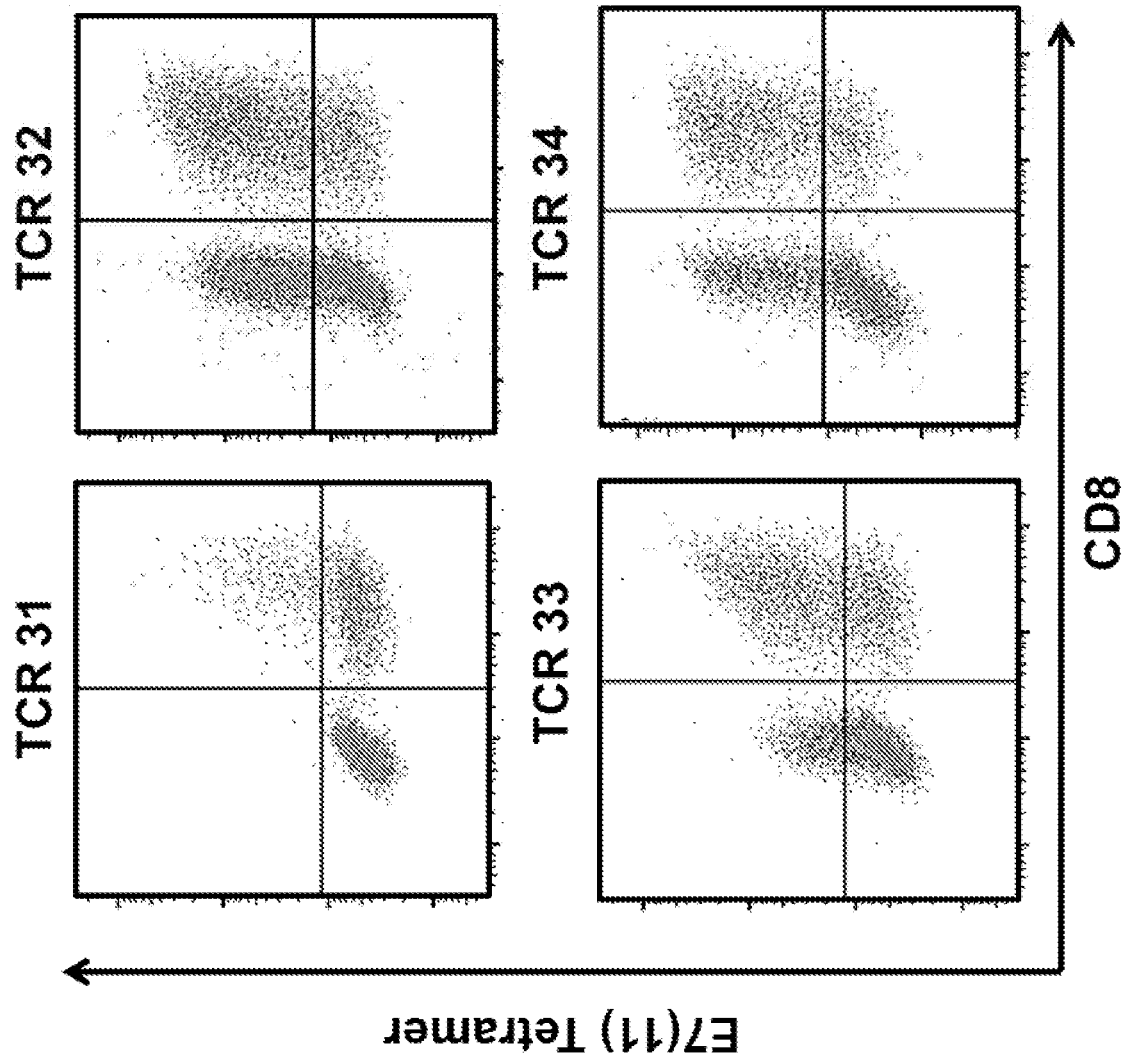
Figure 6C:
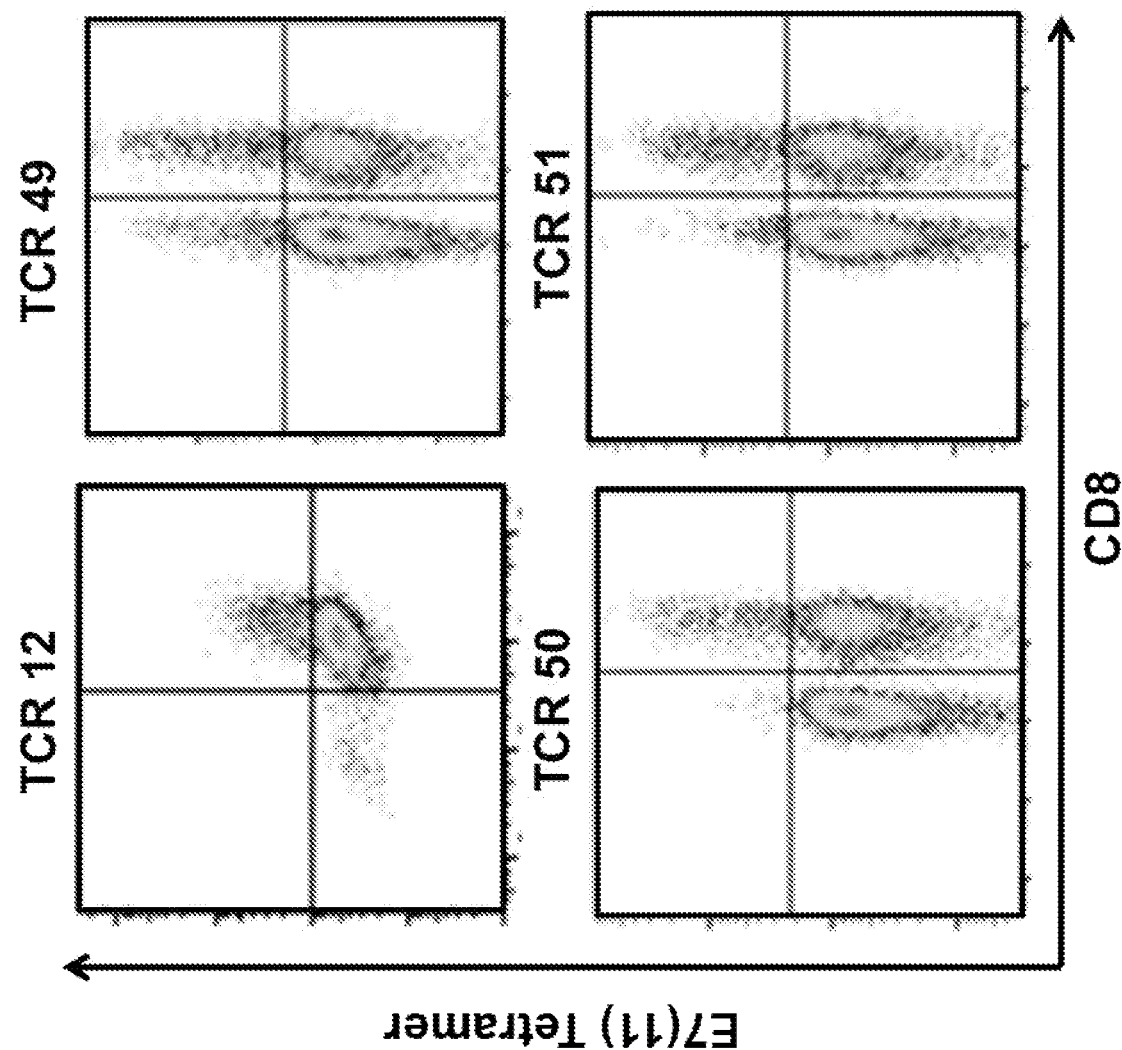
Figure 6E:
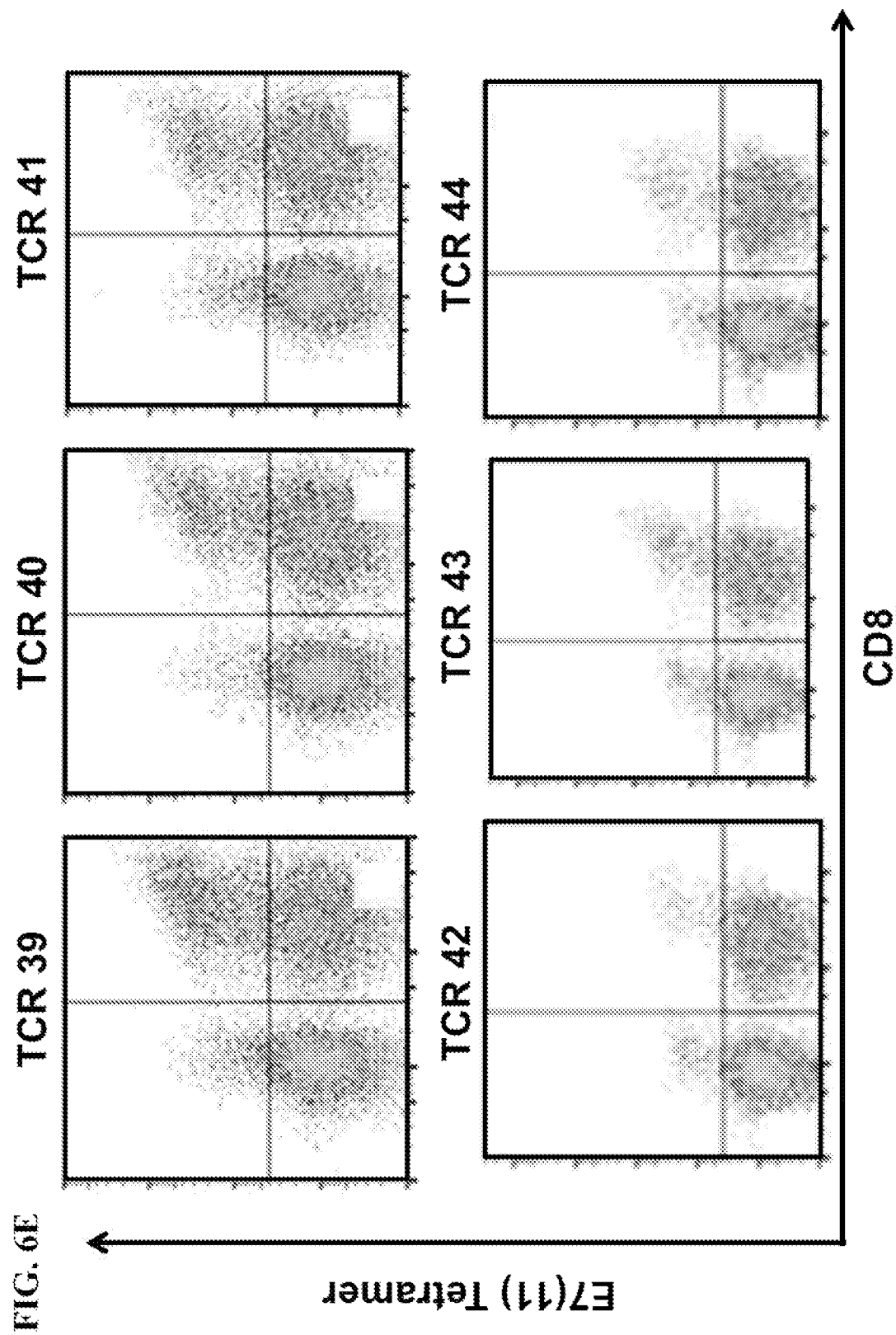
Figure 6F:
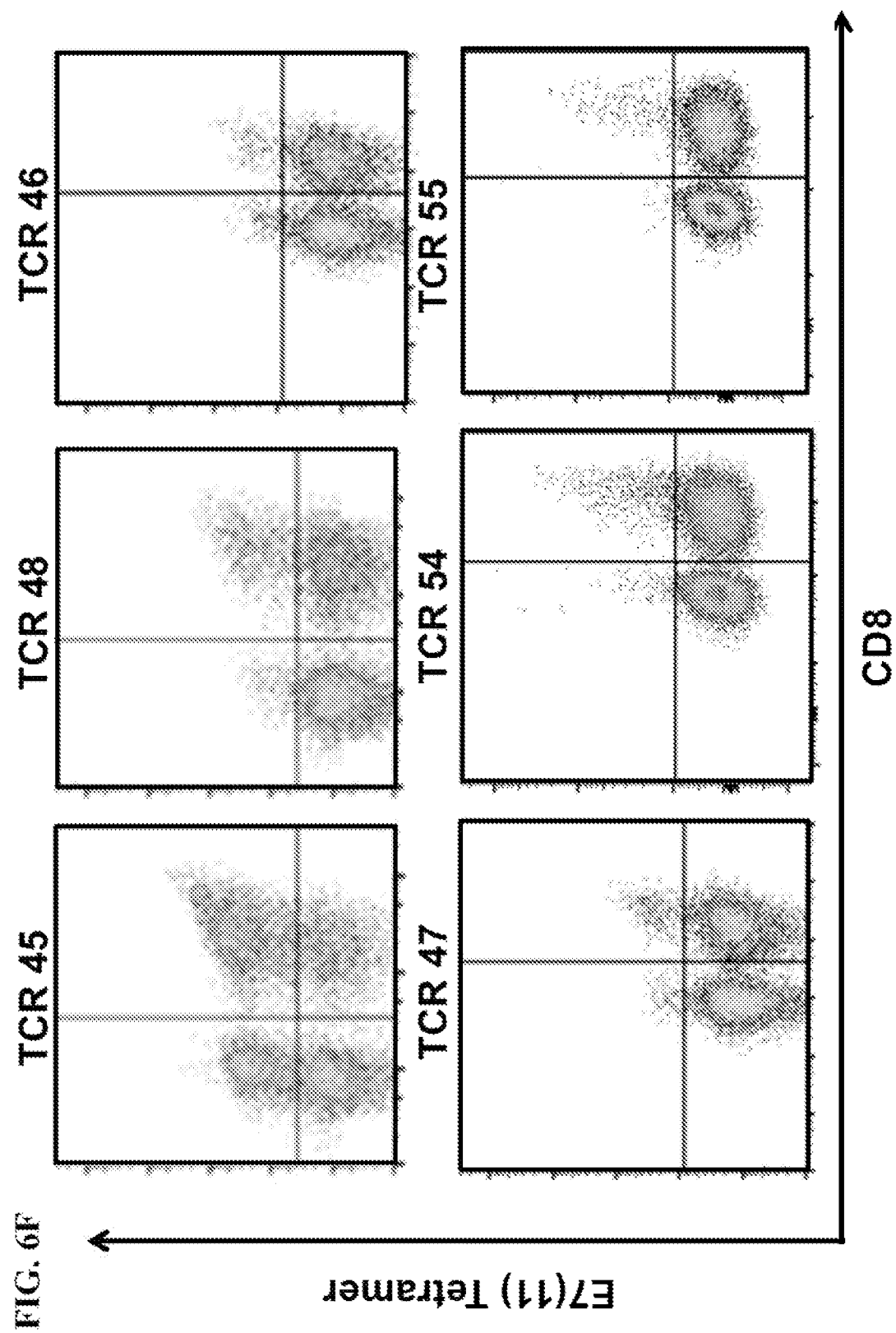
Figure 6G:
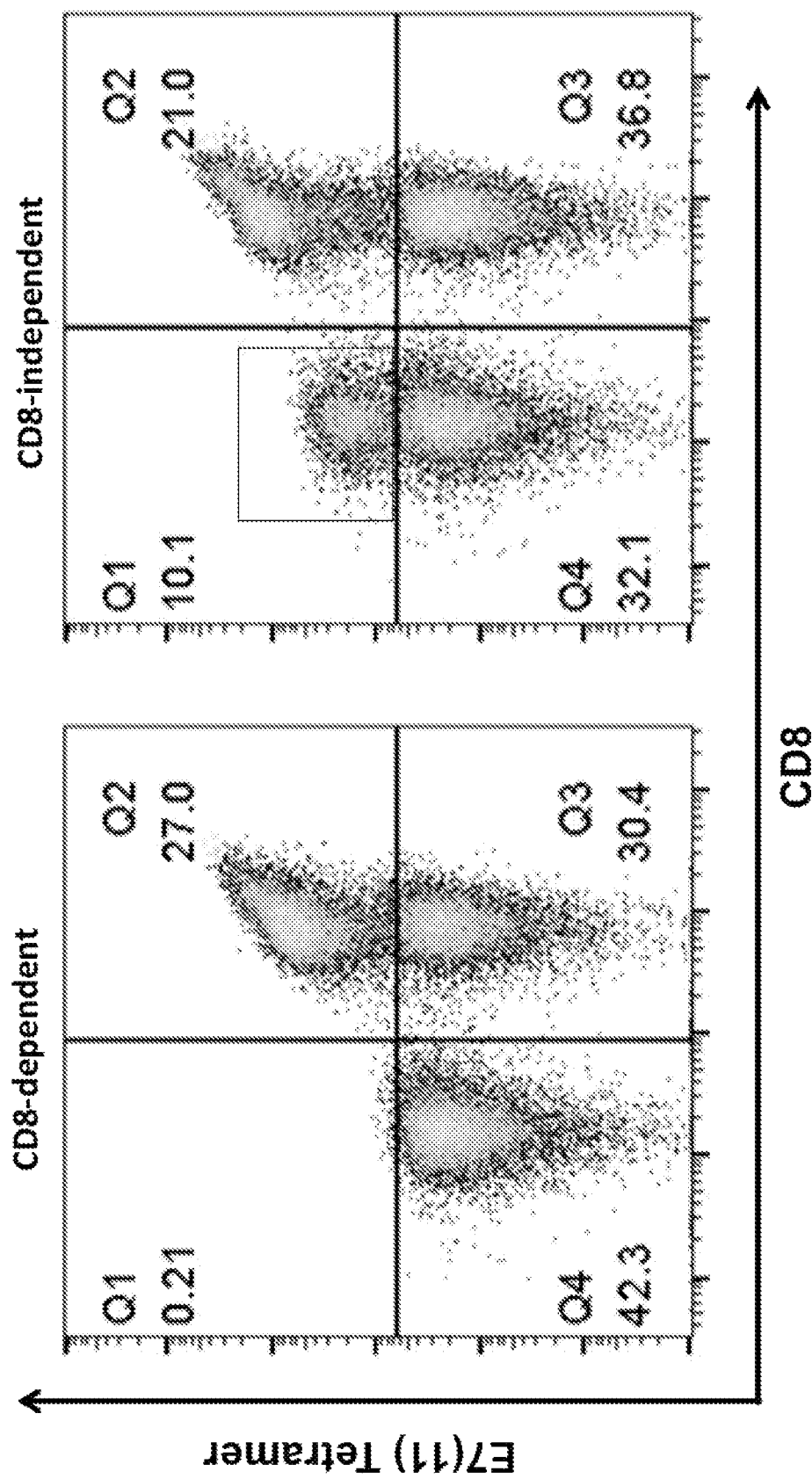

The results of an additional study assessing the CD8-independent tetramer binding of cells expressing exemplary recombinant E7-specific TCRs, TCR37 and TCR49 that were codon-optimized and cysteine-modified, are shown in FIG. 6G. As shown, cells expressing exemplary recombinant TCR, TCR49, were observed to exhibit CD8-dependent tetramer binding (left panel), and cells expressing exemplary recombinant TCR, TCR37, were observed to exhibit some CD8-independent tetramer binding. The results were consistent with a finding that certain MHC Class I-restricted recombinant TCRs can function in CD4+ cells, showing CD8-independent tetramer binding.

Example 6: Expression and Assessment of Exemplary Recombinant T Cell Receptors (TCRs) in Primary T Cells Expression and function of exemplary recombinant E7-specific TCRs in primary human T cells was assessed.

Primary human CD4+ and CD8+ T cells were transduced with lentiviral preparations encoding TCR 16, specific for HPV 16 E6(29-38); and TCR 49, TCR 53 and TCR 37, each specific for HPV 16 E7(11-19) (described above in Example 4 above, and that were codon optimized and cysteine-modified). Approximately $5 \times 10^6$ primary human CD4+ and CD8+ T cells were isolated by immunoaffinity-based selection from human peripheral blood mononuclear cells (PBMCs) obtained from healthy donors. The cells were stimulated for 24 hours by culturing with an anti-CD3/anti-CD28 reagent in media containing human serum and cytokines, at 37° C. prior to lentiviral transduction. Stimulated cells were transduced with a lentiviral preparation encoding TCR 16, TCR 49, TCR 53 or TCR 37, or a mock transduction control (cells treated under the same conditions used for lentiviral transduction but without addition of lentivirus). The lentiviral constructs also contained sequences encoding EGFRt as a surrogate marker for transduction and expression, separated from the recombinant TCR encoding sequences by a sequence encoding a T2A ribosome skip sequence. Following transduction, the cells were cultured in media containing human serum and cytokines. On day 13 after transduction, the cells were assessed by flow cytometry for staining with an anti-CD3 antibody, an anti-CD8 antibody, and a HPV 16 E6(29-38)- or HPV16 E7(11-19)-peptide-MHC tetramer complex. Interferon-gamma (IFNγ) production was assessed following incubation of recombinant TCR-expressing cells with a squamous cell carcinoma cell line UPCI:SCC152 (ATCC® CRL-3240™), an antigen-specific target cell line which is HPV+, at an E:T ratio of 7.5:1 or 3.25:1 for TCR 16-expressing cells, and E:T ratio of 2.5:1 for TCR 49-, TCR 53- or TCR 37-expressing cells.

The results showed binding of the respective peptide-MHC tetramer complex specific for each TCR. TCR 16-expressing cells produced IFNγ at levels above background at both E:T ratios tested. CD8+ cells expressing TCR 49, TCR 53 or TCR 37 produced IFNγ at levels above background, and CD4+ cells expressing TCR 53 and TCR 37 produced IFNγ at levels above background, consistent with CD8-independent function of these TCRs in primary T cells. The results are consistent with expression, cell surface expression and antigen-specific function of the recombinant TCRs in primary T cells.

Example 7: Assessment of Primary T Cells with Endogenous TCR Gene Knock-Out

Primary human CD4+ and CD8+ T cells were isolated and engineered to introduce a genetic disruption to knockout (KO) the endogenous gene loci that encode the T cell receptor alpha (TCRα) and beta (TCRβ) chains or both by CRISPR/Cas9-mediated gene editing. Primary CD4+ and CD8+ T cells from two healthy human donors were isolated by immunoaffinity-based selection from human peripheral blood mononuclear cells (PBMCs) obtained from healthy donors. The isolated CD4+ and CD8+ cells were stimulated for 72 hours at 37° C. by culturing with an anti-CD3/anti-CD28 reagent at a 1:1 bead:cell ratio in media containing human serum, IL-2, IL-7 and IL-15.

For introducing genetic disruption at the TCR loci, the anti-CD3/anti-CD28 reagent was removed, and the cells were electroporated with either 2 µM ribonucleoprotein (RNP) complexes containing *Streptococcus pyogenes* Cas9 and a guide RNA (gRNA) targeting TCR α constant regions gene (TRAC), or 2 µM RNP complexes containing *S. pyogenes* Cas9 and a gRNA targeting the TCR β constant region genes (TRBC). For targeting both TRAC and TRBC, a mixture of the RNP complexes were electroporated. Specifically, the TRAC locus was targeted for genetic disruption with a gRNA with the targeting domain sequence GAGAAUCAAAAUCGGUGAAU (SEQ ID NO:1048; target site sequence for TRAC set forth in SEQ ID NO:1182), which targets a genetic disruption within exon 1 of the endogenous TCR α constant region (TRAC) gene. The TRBC loci were targeted for genetic disruption with a consensus target site sequence common to exon 1 of both TCR β constant regions 1 and 2, with the targeting domain sequence GGCCUCGGCGCUGACGAUCU (SEQ ID NO:1053; target site sequence for TRBC set forth in SEQ ID NO:1054). As a control, cells were treated under the same conditions used for electroporation but without addition of an RNP (mock).

Figure 7A:
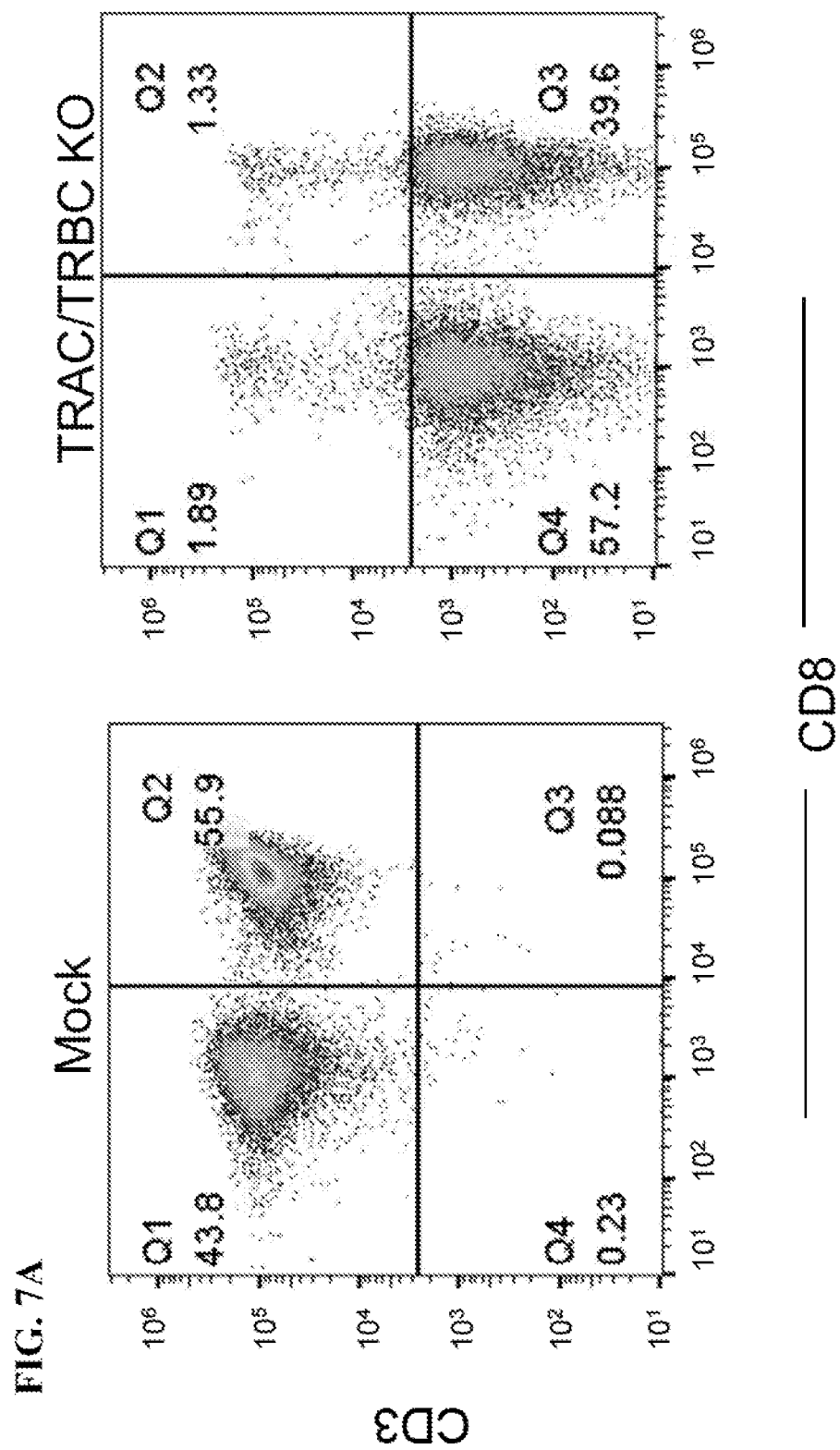
FIGS. 7A and 7B show knock-out efficiency for the endogenous TCR gene in primary T cells as measured by evaluation of evaluating CD3 expression using flow cytometry.
Figure 7B:
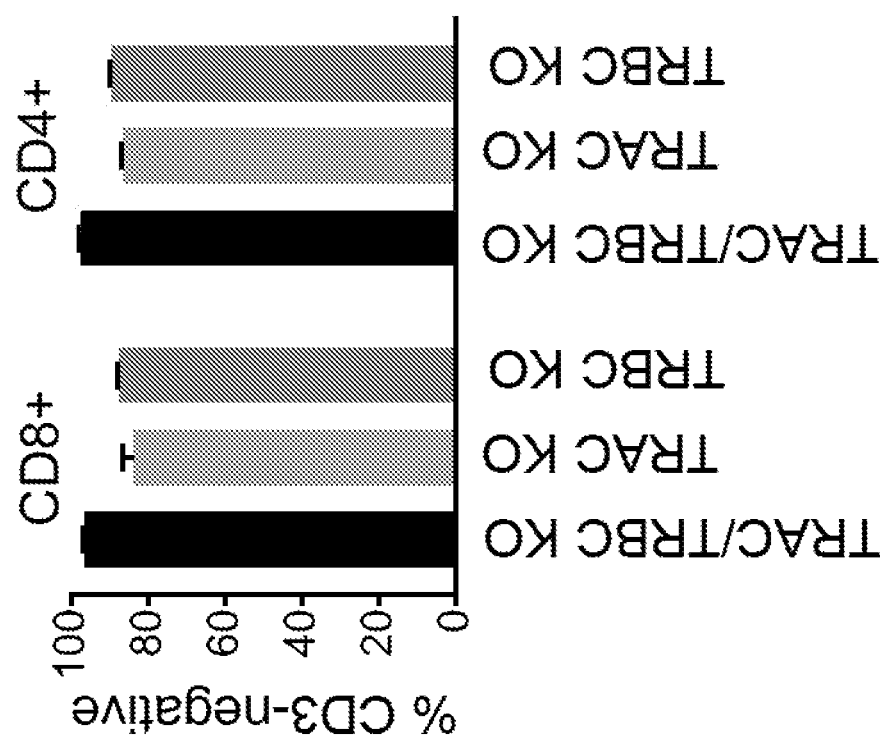

Knockout efficiency was measured by evaluating CD3 expression using flow cytometry 5 days after transfection, and the percentage of CD3-population was determined. As shown in FIGS. 7A and 7B, cells electroporated with RNPs targeting the endogenous TCR genes to disrupt the endogenous gene loci that encode the T cell receptor alpha (TCRα) constant and beta (TCRβ) constant chains or both, resulted in cells that did not express CD3, indicating that they were knocked out for the expression of the endogenous TCR. In this study, approximately 80% of cells were knocked out for the endogenous TCR as determined by CD3 expression when either TRAC or TRBC were targeted individually, with a greater number of cells knocked out for the endogenous TCR when both TRAC and TRBC were targeted.

Example 8: Expression of Exemplary Recombinant T Cell Receptors (TCRs) in Primary T Cells with Endogenous TCR Gene Knock-Out Primary human T cells were knocked out for the endogenous T cell receptor-encoding genes using CRISPR/Cas9 mediated gene editing, and transduced with lentiviral vector particles encoding exemplary recombinant E6- or E7-specific TCRs.

A. Knock-Out of Endogenous TCR Genes and Expression of Recombinant TCR in Primary T Cells Approximately 5×10⁶ primary human CD4+ and CD8+ T cells were isolated by immunoaffinity-based selection from human peripheral blood mononuclear cells (PBMCs) obtained from healthy donors. The cells were stimulated for 24 hours by culturing with an anti-CD3/anti-CD28 reagent in media containing human serum, interleukin-2 (IL-2), IL-7 and IL-15 at 37° C. prior to lentiviral transduction. Stimulated cells were transduced with a lentiviral preparation encoding TCR 16 (codon-optimized and cysteine-modified), specific for HPV 16 E6(29-38); TCR 31 (codon-optimized and cysteine-modified), specific for HPV 16 E7(11-19), described in Example 4 above; or a mock transduction control (cells treated under the same conditions used for lentiviral transduction but without addition of lentivirus. The lentiviral constructs also contained sequences encoding a truncated receptor as a surrogate marker for transduction and expression, separated from the recombinant TCR-encoding sequences by a sequence encoding a T2A ribosome skip sequence. Following transduction, the cells were cultured for 36-48 hours in media containing human serum and IL-2, IL-7 and IL-15.

To knock out the endogenous TCR genes, cells were electroporated with a mixture of ribonucleoprotein (RNP) complexes containing a guide RNA (gRNA) designed to target a target site within exon 1 of the TCR α constant regions gene (gRNA targeting domain sequence for TRAC set forth in SEQ ID NO:1048; target site sequence for TRAC set forth in SEQ ID NO:1182) and RNP complexes containing a gRNA designed to target a consensus target site sequence common to exon 1 of both TCR β constant regions 1 and 2 (gRNA targeting domain sequence for TRBC set forth in SEQ ID NO:1053; target site sequence for TRBC set forth in SEQ ID NO:1054) and *Streptococcus pyogenes* Cas9 protein, for CRISPR/Cas9 mediated gene editing of the TRAC and TRBC loci (endo. TCR KO).

As a control, cells were treated under the same conditions used for electroporation but without addition of an RNP (endo. TCR WT). The cells were subsequently cultured in culture media containing cytokines. Three days after electroporation with RNP, transduced cells were enriched by selection with an antibody directed against the surrogate marker, and cultured for 8 additional days.

On day 13 after transduction (day 11 after electroporation), the cells were assessed by flow cytometry for staining with an anti-CD3 antibody, an anti-CD8 antibody, and a labeled MHC tetramer complexed with the antigen recognized by the recombinant TCR (HPV16 E6 or E7 peptide). Cytokine production was monitored following incubation of recombinant TCR-expressing cells with a squamous cell carcinoma cell line UPCI:SCC152 (ATCC® CRL-3240™), an antigen-specific target cell line that are HPV+, at an E:T ratio of 7.5:1, 3.25:1 or 0:1 for 48 hours. Secretion of interferon-gamma (IFNγ), IL-2 and tumor necrosis factor alpha (TNFα) was determined by ELISA.

B. Results

Figure 8A:
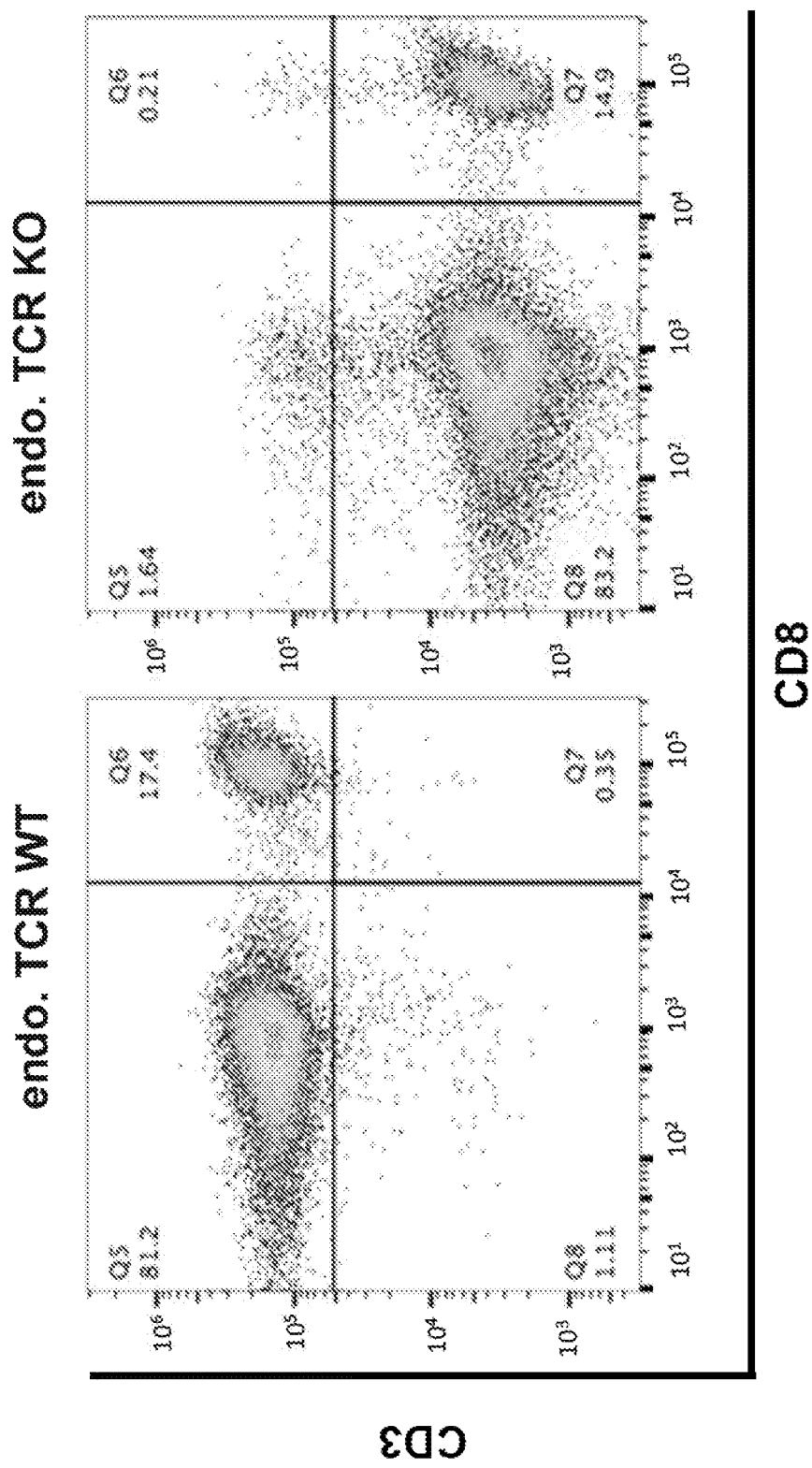
FIG. 8A shows the flow cytometry results to assess the knock-out efficiency for endogenous TCR in cells electroporated with RNPs targeting the endogenous TCR genes (endo. TCR KO) compared to control cells (endo. TCR WT).

The knock-out efficiency of the endogenous TCR was assessed by determining the percentage of CD3-population. As shown in FIG. 8A, more than 98% of cells electroporated with RNPs targeting the endogenous TCR genes (endo. TCR KO) did not express CD3, indicating that they were knocked out for the expression of the endogenous TCR. In comparison, more than 98% of the control cells (endo. TCR WT) expressed CD3. The results showed that nearly all of the population of cells was knocked out for the endogenous TCR-encoding genes.

Figure 8B:
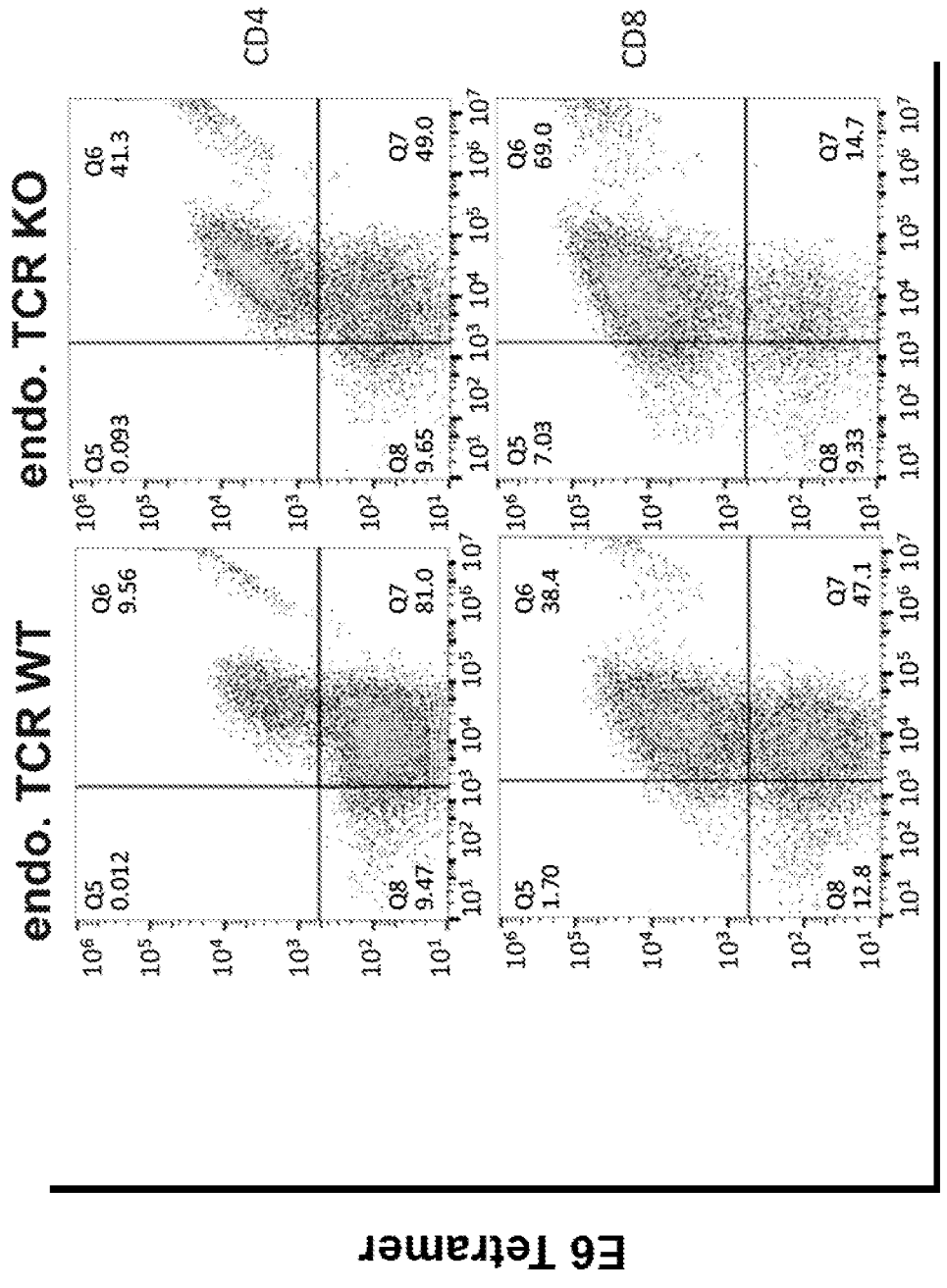
FIG. 8B shows the results of flow cytometry analysis assessing the expression of surrogate marker for TCR expression and E6 tetramer binding, in CD4 and CD8 cells.

Recombinant TCR expression was compared in cells with or without knock-out of the endogenous TCR genes. As shown in FIG. 8B, in cells transduced to express TCR 16, the percentage of cells that expressed the TCR (as assessed by the surrogate marker) and bound the peptide-MHC tetramer was increased in the endogenous TCR knock-out cells (endo. TCR KO), compared to control cells (endo. TCR WT) transduced to express TCR16. The results are consistent with a finding that knocking out the endogenous TCR in primary T cells results in improved expression of the recombinant TCR.

Figure 8C:
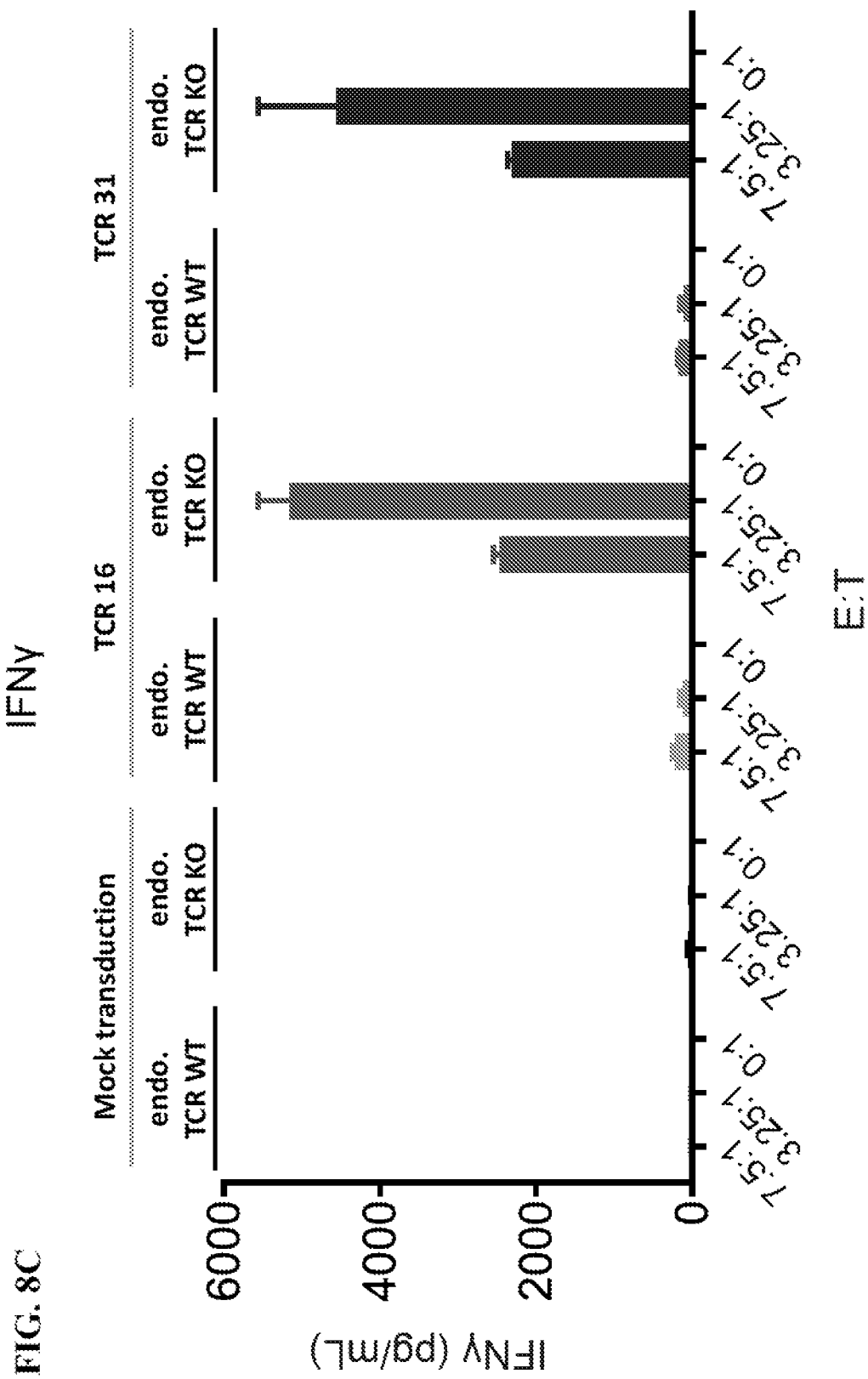
FIG. 8C shows the production of IFNγ by endogenous TCR (endo. TCR WT) and endogenous TCR KO (endo. TCR KO) cells for TCR 16 and 31, and compared to mock transduction control.

Following incubation with the antigen-specific target cell line, cells expressing recombinant TCRs and knocked out for the endogenous TCR genes (endo. TCR KO) produced more IFNγ compared to control cells (endo. TCR WT)

expressing the same TCR and the mock transduction control (FIG. 8C). Similar results were observed for IL-2 and TNFα production.

Example 9: Assessment of Expression and Function of Exemplary Recombinant T Cell Receptors (TCRs) in Primary T Cells with or without Endogenous TCR Gene Knock-Out Expression and function of exemplary recombinant E7-specific TCRs was assessed in primary human T cells with or without knock-out of the endogenous TCR genes or in which the recombinant E7-specific TCRs were expressed as chimeric TCRs with a mouse constant region.

Primary human CD4+ and CD8+ T cells were transduced with lentiviral preparations encoding TCR 49, TCR 53 and TCR 37, each specific for HPV 16 E7(11-19) (codon optimized and cysteine-modified, described above in Example 4 above), and a surrogate marker, using methods substantially as described in Example 6. As an alternative approach, primary human CD4+ and CD8+ T cells were transduced with lentiviral preparations encoding each TCR where the Cα and the Cβ of the recombinant TCR were replaced by constant regions from a mouse TCR (mouse constant; mouse Cα sequence set forth in SEQ ID NO:1012; mouse Cβ sequence set forth in SEQ ID NO:1013). As a control, cells were treated under the same conditions used for lentiviral transduction but without addition of lentivirus (mock transduction).

Cells transduced with TCR 49, TCR 53 or TCR 37 (containing the human constant region) were electroporated with TRAC- and TRBC-targeting CRISPR/Cas9 RNPs to knock out the endogenous TCR genes (endo. TCR KO) substantially as described in Example 8, or were treated under the same conditions used for electroporation but without addition of an RNP (endo. TCR WT). The other transduced cell conditions also were treated under the same conditions for electroporation but without addition of an RNP. The cells were enriched and cultured, generally as described in Example 8A above.

On day 13 after transduction (day 11 after electroporation), the cells were assessed by flow cytometry for staining with an anti-CD3 antibody, an anti-CD8 antibody, and a HPV16 E7(11-19) peptide-MHC tetramer complex. Interferon-gamma production was assessed following incubation of recombinant TCR-expressing cells with the antigen-specific UPCI:SCC152 target cells at an E:T ratio of 2.5:1. Cytolytic activity was assessed by incubating CD4+ or CD8+ cells expressing each of the recombinant TCRs with antigen-specific UPCI:SCC152 target cells (stably expressing NucLight Red), and assessing integrated fluorescence intensity over time using an automated microscope.

Results

Figure 9A:
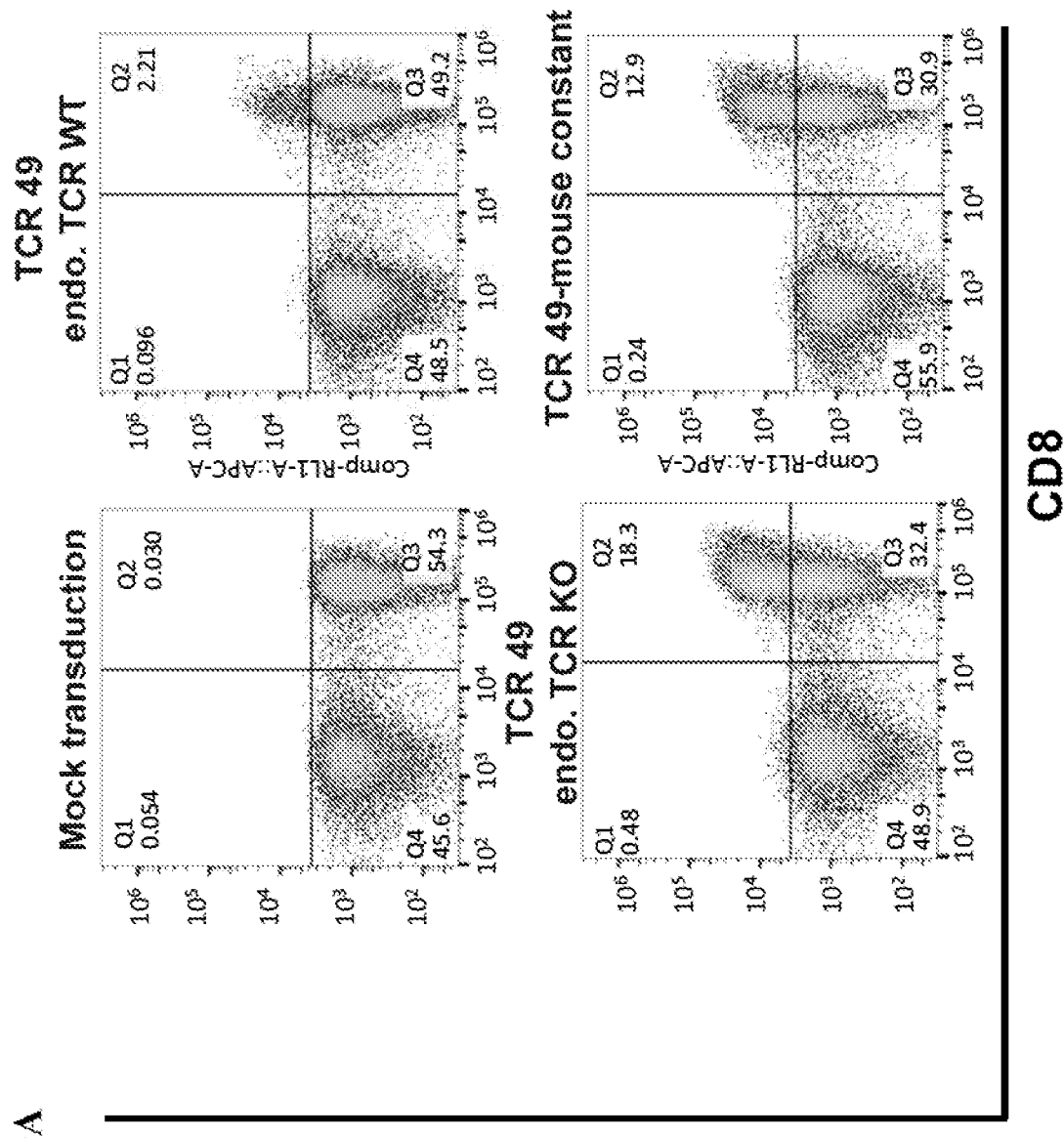
FIGS. 9A-9J show the expression of the TCRs, as assessed by E7(11-19) tetramer binding, cytolytic activity and interferon-gamma production following incubation with antigen-specific target cells, in cells engineered to express various exemplary recombinant TCRs.
Figure 9B:
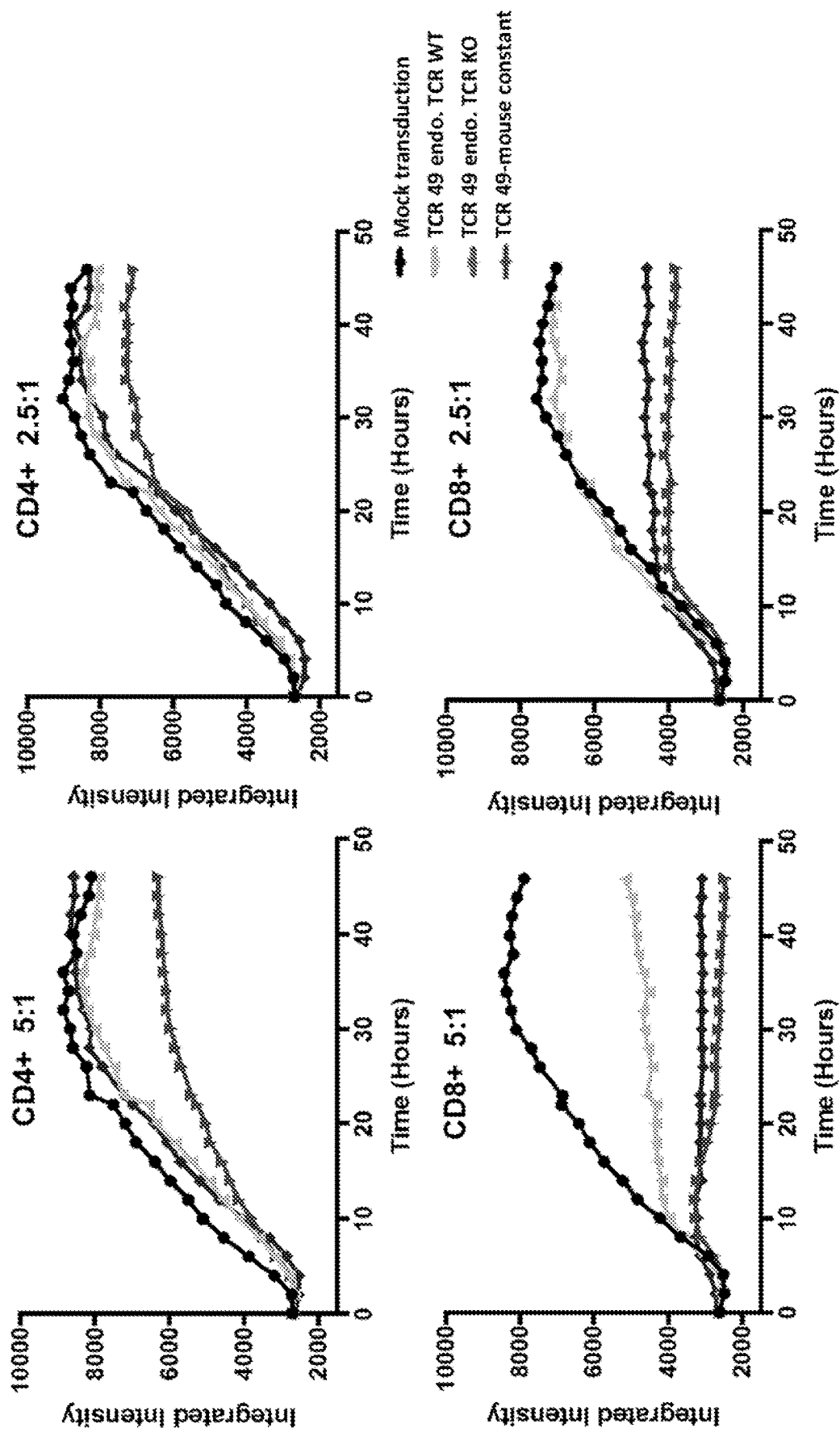
Figure 9C:
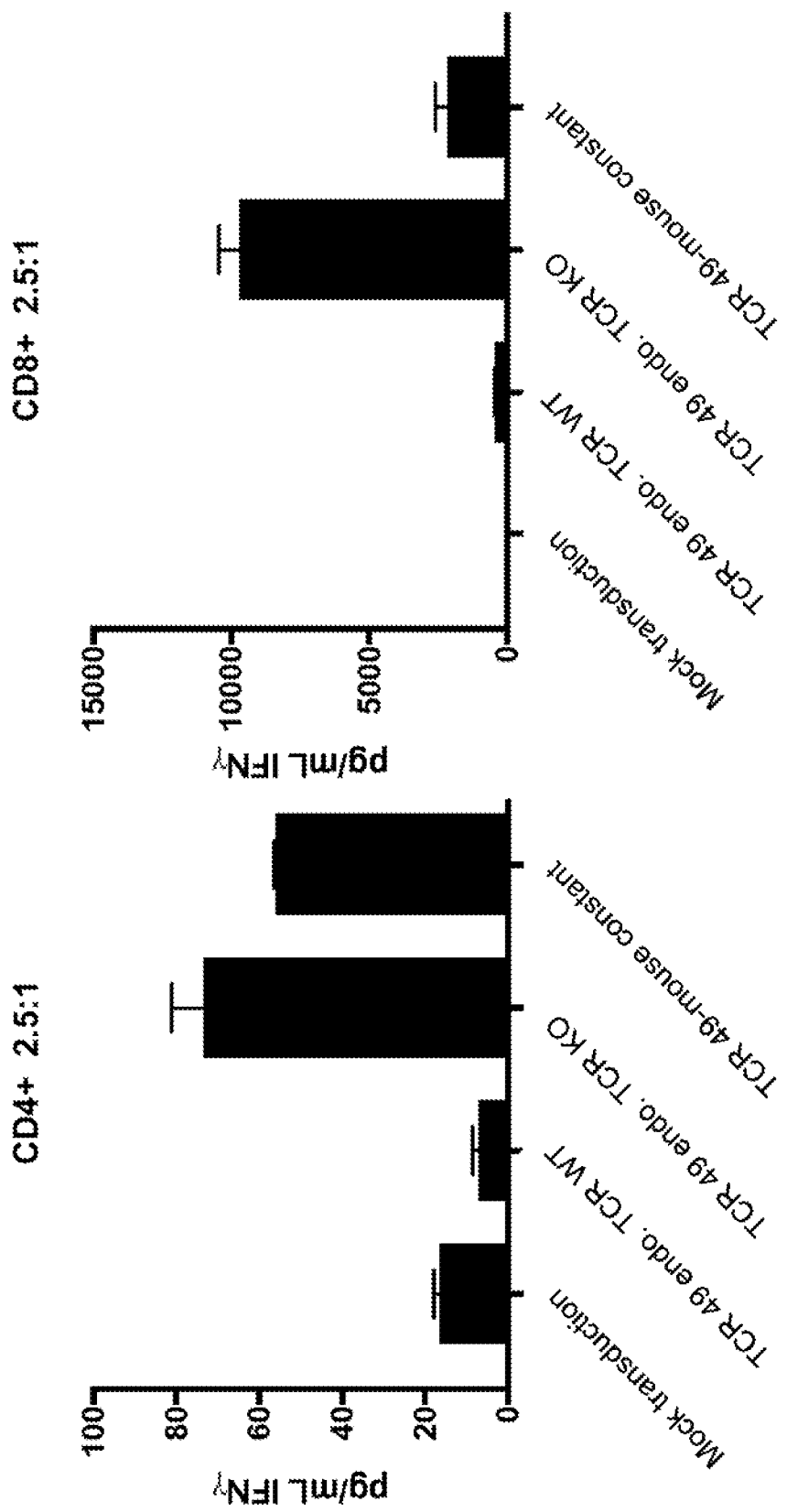
Figure 9D:
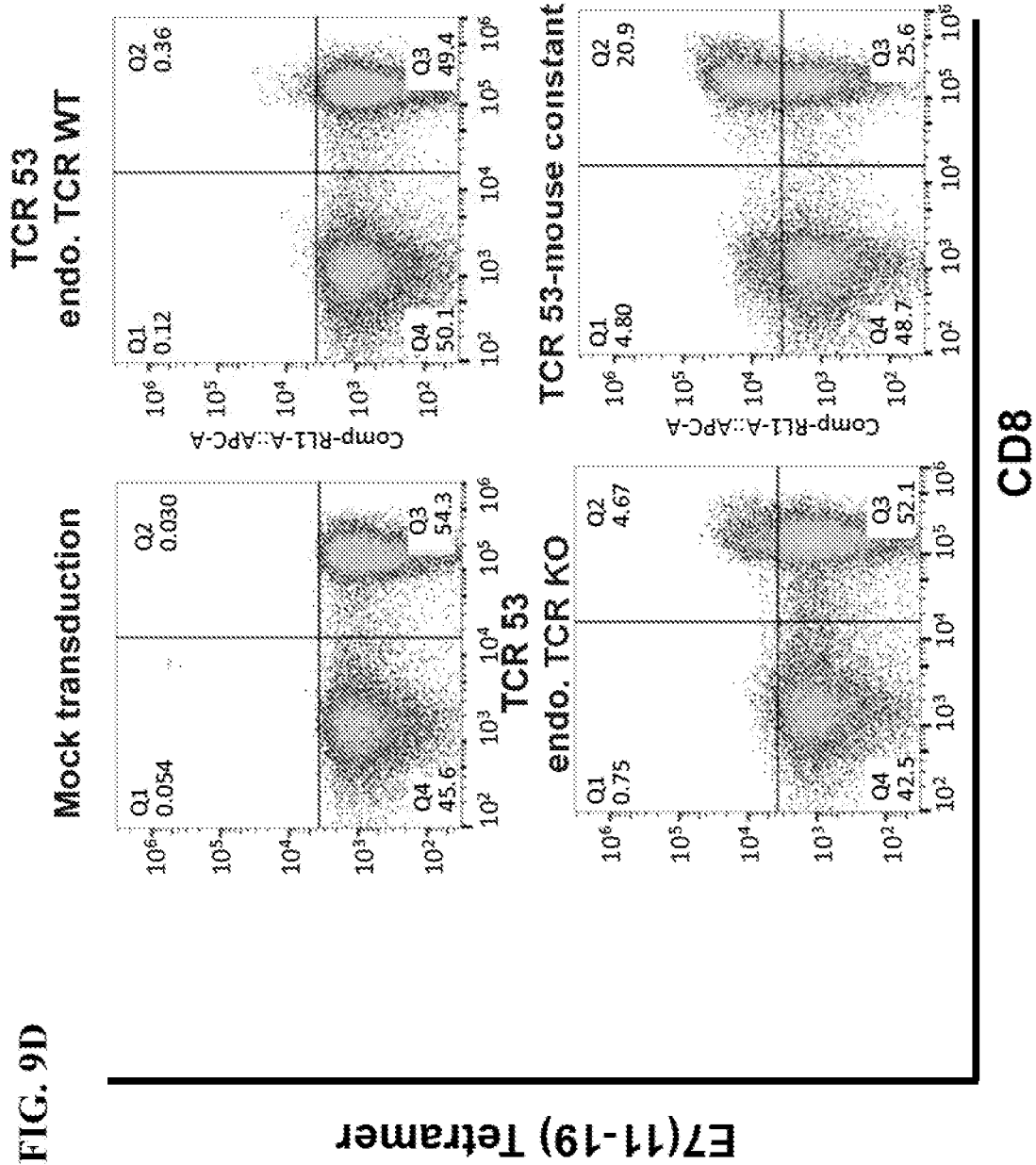
Figure 9E:
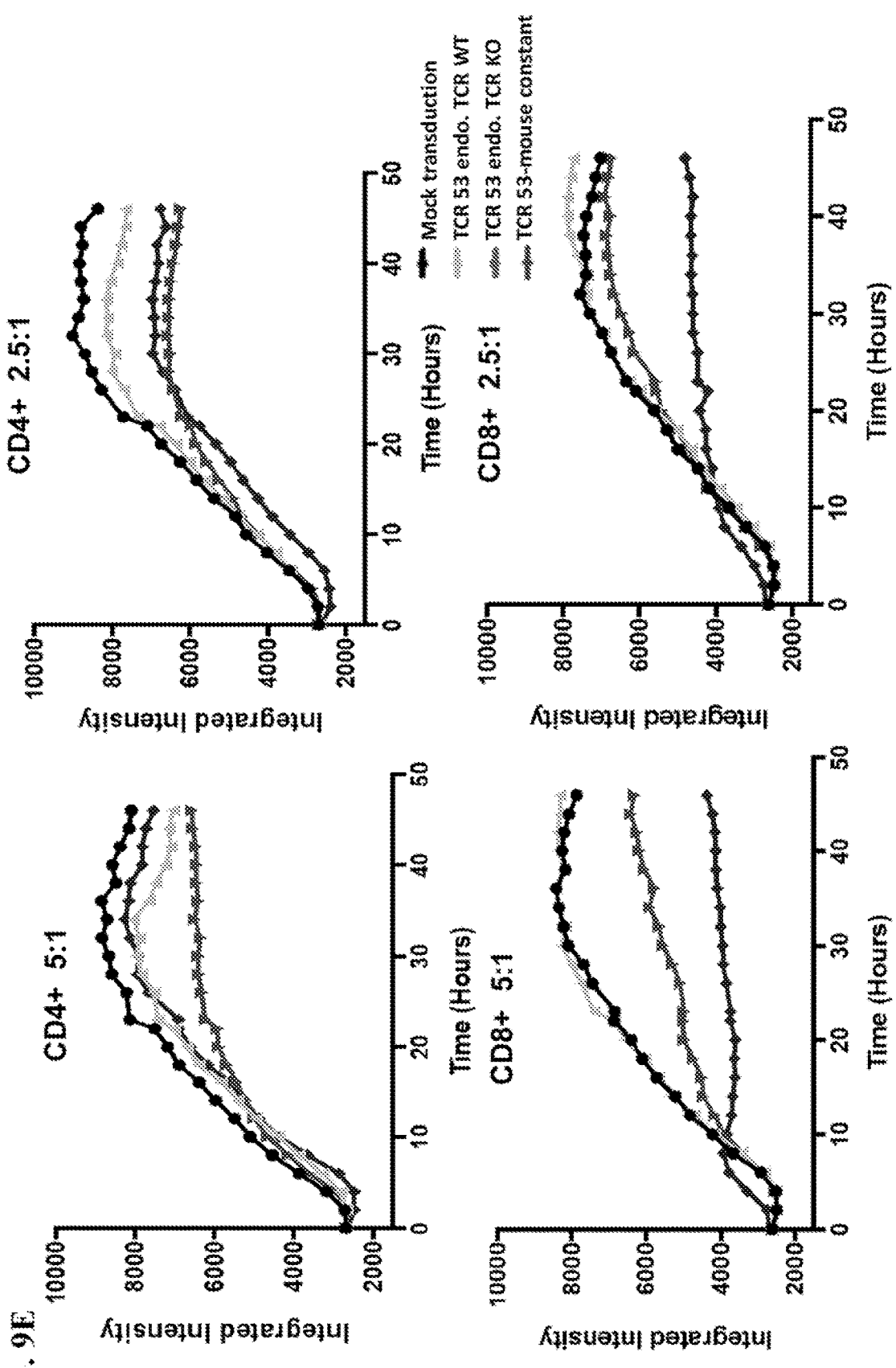
Figure 9F:
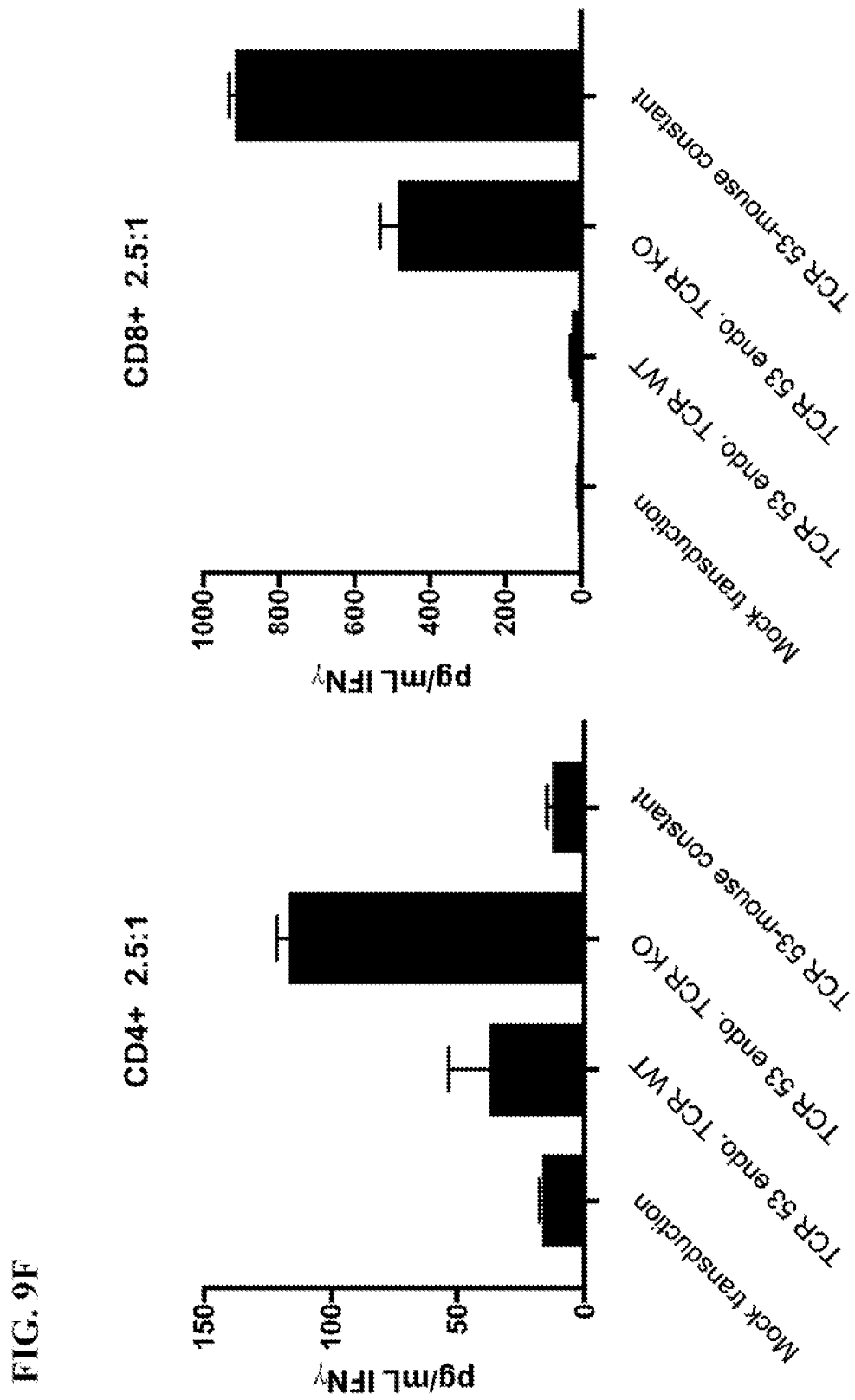
Figure 9G:
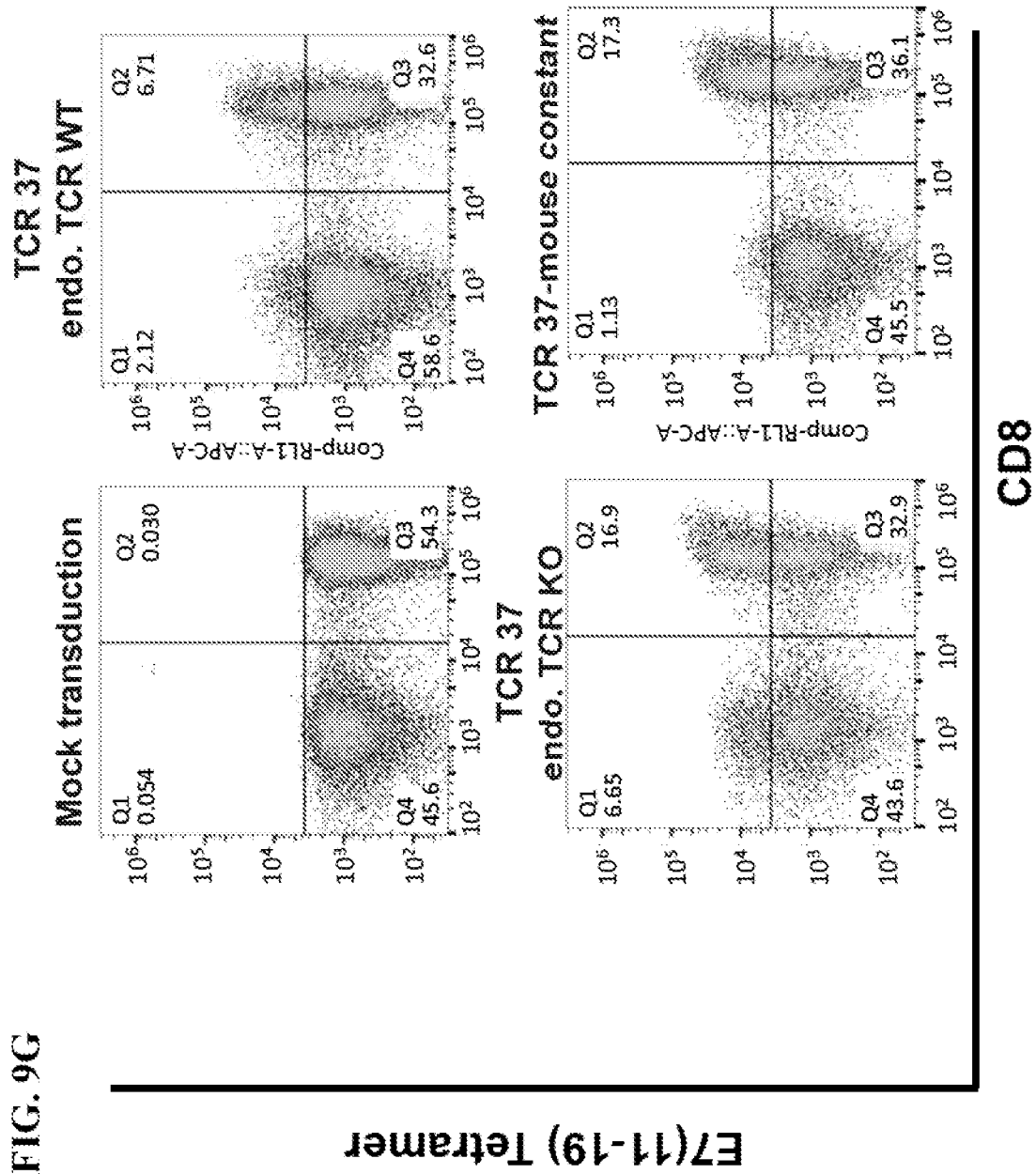
Figure 9H:
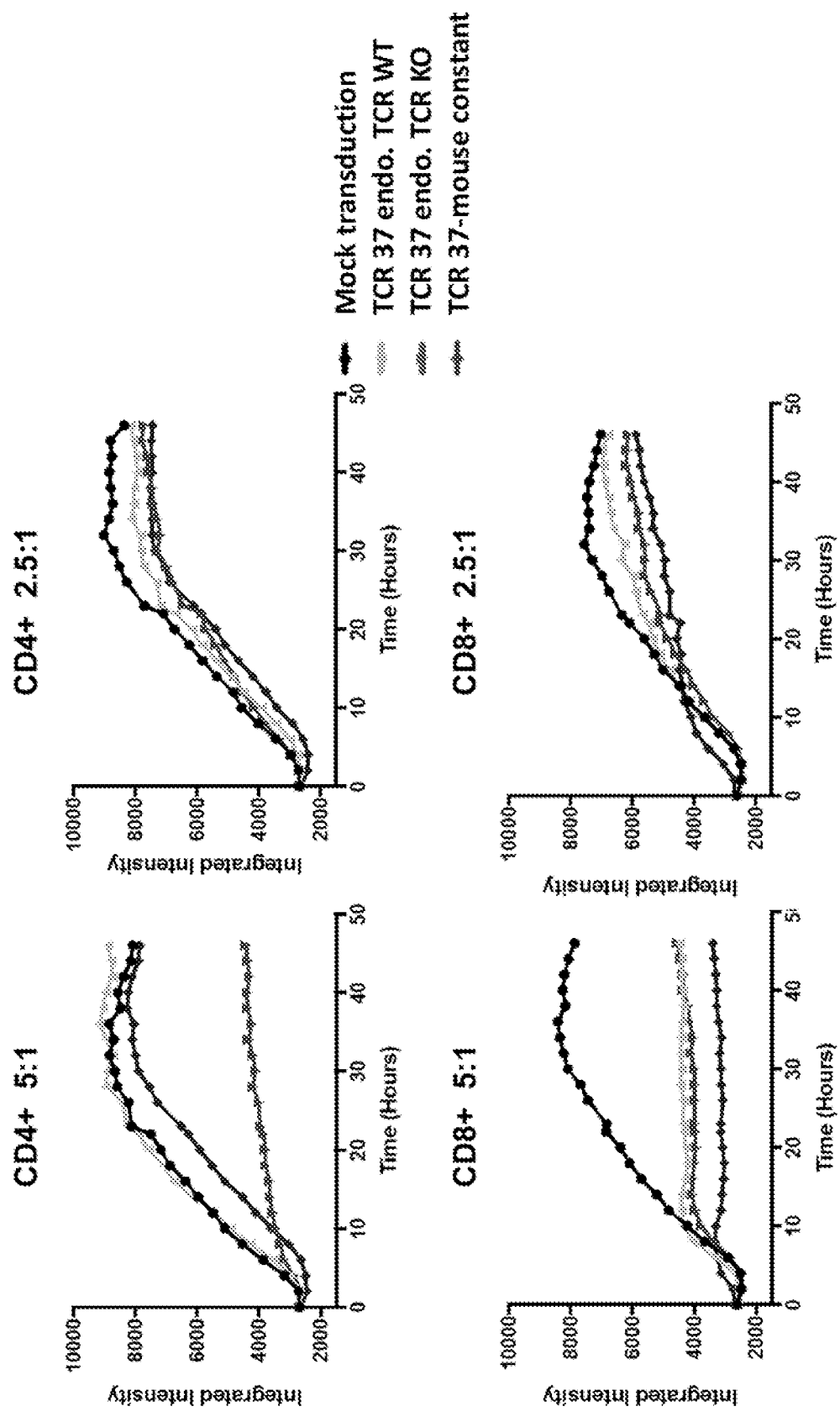
Figure 9I:
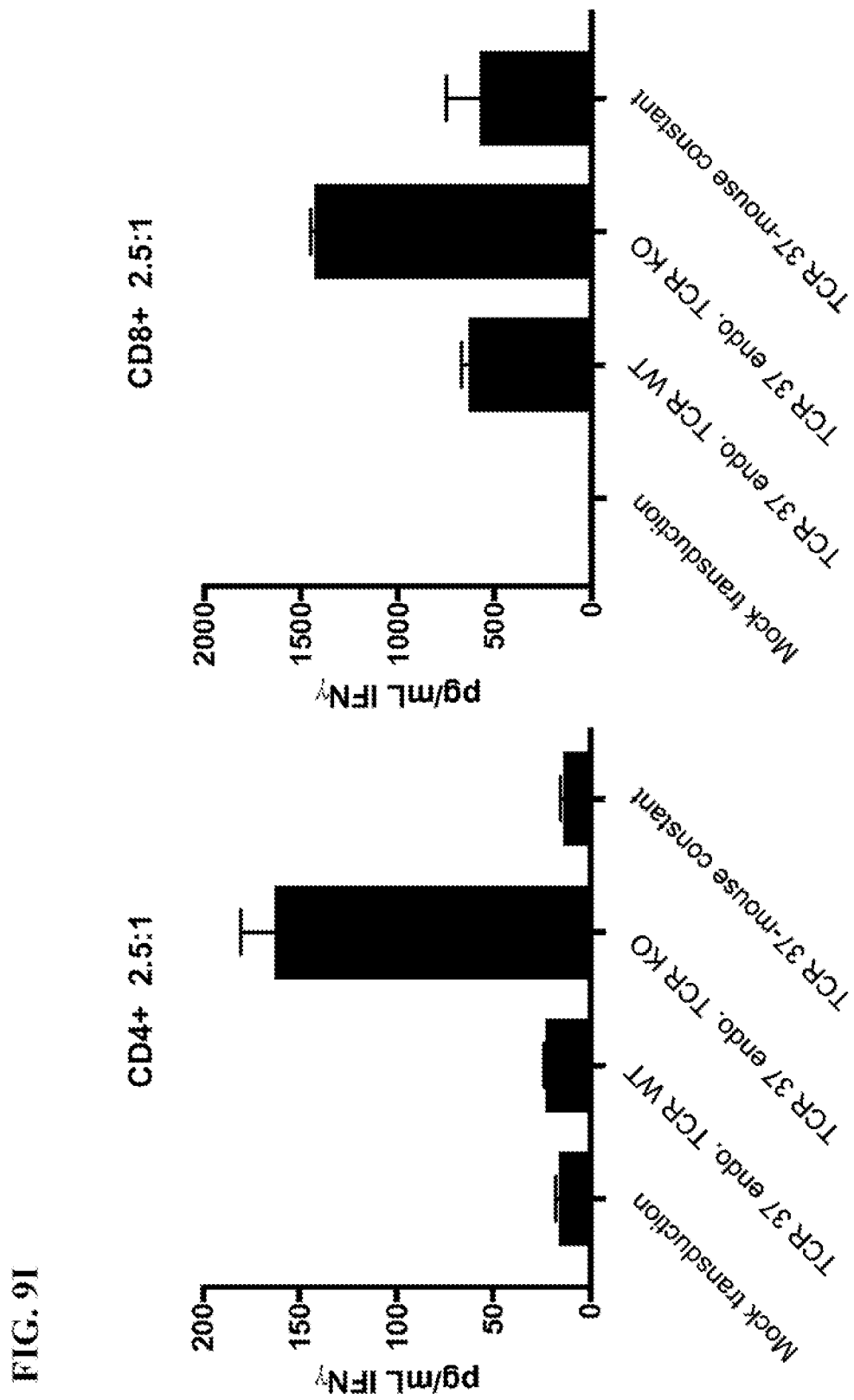
Figure 9J:
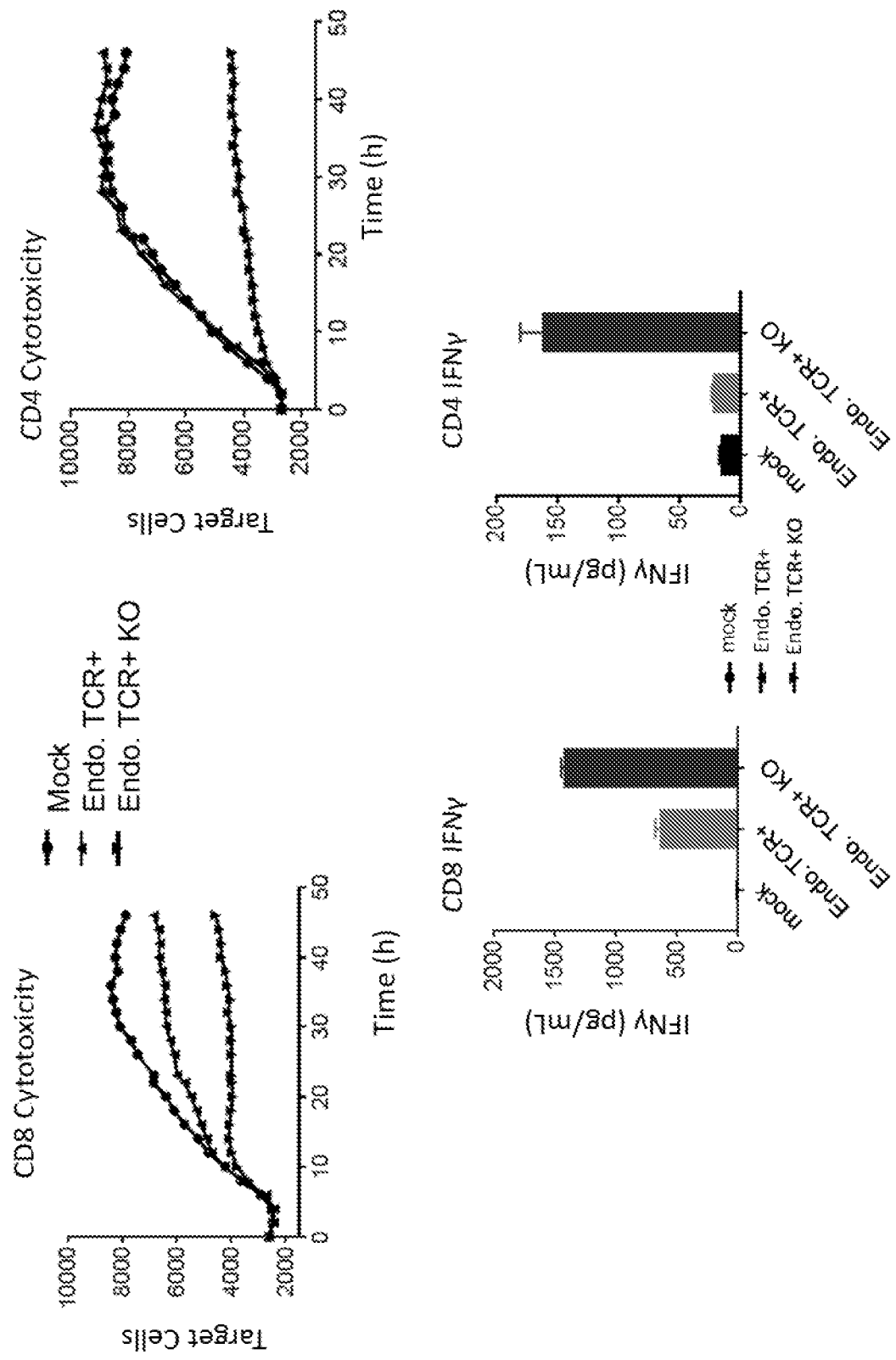

As shown in FIG. 9A (TCR 49), FIG. 9D (TCR 53) and FIG. 9G (TCR 37), expression of the TCRs, as assessed by E7(11-19) tetramer binding, was greater in cells with knock-out of the endogenous TCR genes (endo. TCR KO), compared to in cells that retained the endogenous TCR genes (endo. TCR WT). Increased expression of the recombinant TCRs in primary human T cells also was achieved by introduction of the TCR as a chimeric TCR containing a mouse constant region. In some cases, observed CD8-independent tetramer binding also was increased in cells in which the TCR was expressed with knock-out of the endogenous TCR or by expression as a chimeric TCR containing mouse constant region.

Cytolytic activity, as monitored by decreased NucRed light signal, of TCR-expressing cells was observed following incubation with antigen-specific target cells as shown in FIG. 9B (TCR 49), 9E (TCR 53), 9H (TCR 37) and 9J (TCR 37). For each TCR, the degree of cytolytic activity was generally consistent with the observed level of expression of the TCR among the various assessed TCR-expressing cells. In some cases, CD4+ cytolytic activity was observed consistent with CD8-independent activity of the TCR.

As shown in FIG. 9C (TCR 49), 9F (TCR 53), 9I (TCR 37) and 9J (TCR 37), interferon-gamma production by TCR-expressing cells following incubation with antigen-specific target cells also was increased in cells with knock-out of the endogenous TCR genes or in cells in which the TCR was expressed as a chimeric TCR with mouse constant regions. In some cases, increased expression of interferon-gamma was observed in TCR-expressing CD4+ cells consistent with CD8-independent activity of the TCR.

Example 10: Evaluation of Expression, Peptide Sensitivity and Function of Exemplary Recombinant T Cell Receptors (TCRs) in Primary T Cells Eliminated for Endogenous TCR by CRISPR/Cas9-Mediated Gene Editing of TRAC Locus Primary human CD4+ and CD8+ T cells were transduced with lentiviral preparations encoding various exemplary TCRs specific for HPV 16 E7(11-19) (codon optimized and cysteine-modified, as described in Example 4). As a control, cells were treated under the same conditions used for lentiviral transduction but without addition of lentivirus (mock). Cells transduced with TCRs were electroporated with TRAC-targeting CRISPR/Cas9 RNPs (containing gRNA targeting domain sequence for TRAC set forth in SEQ ID NO:1048) to knock out the endogenous TCR genes (endo. TCR KO), or were treated under the same conditions used for electroporation but without addition of an RNP (endo. TCR+). The other transduced cell conditions also were treated under the same conditions for electroporation but without addition of an RNP. The cells were enriched and cultured substantially as described in Example 8.

Figure 10A:
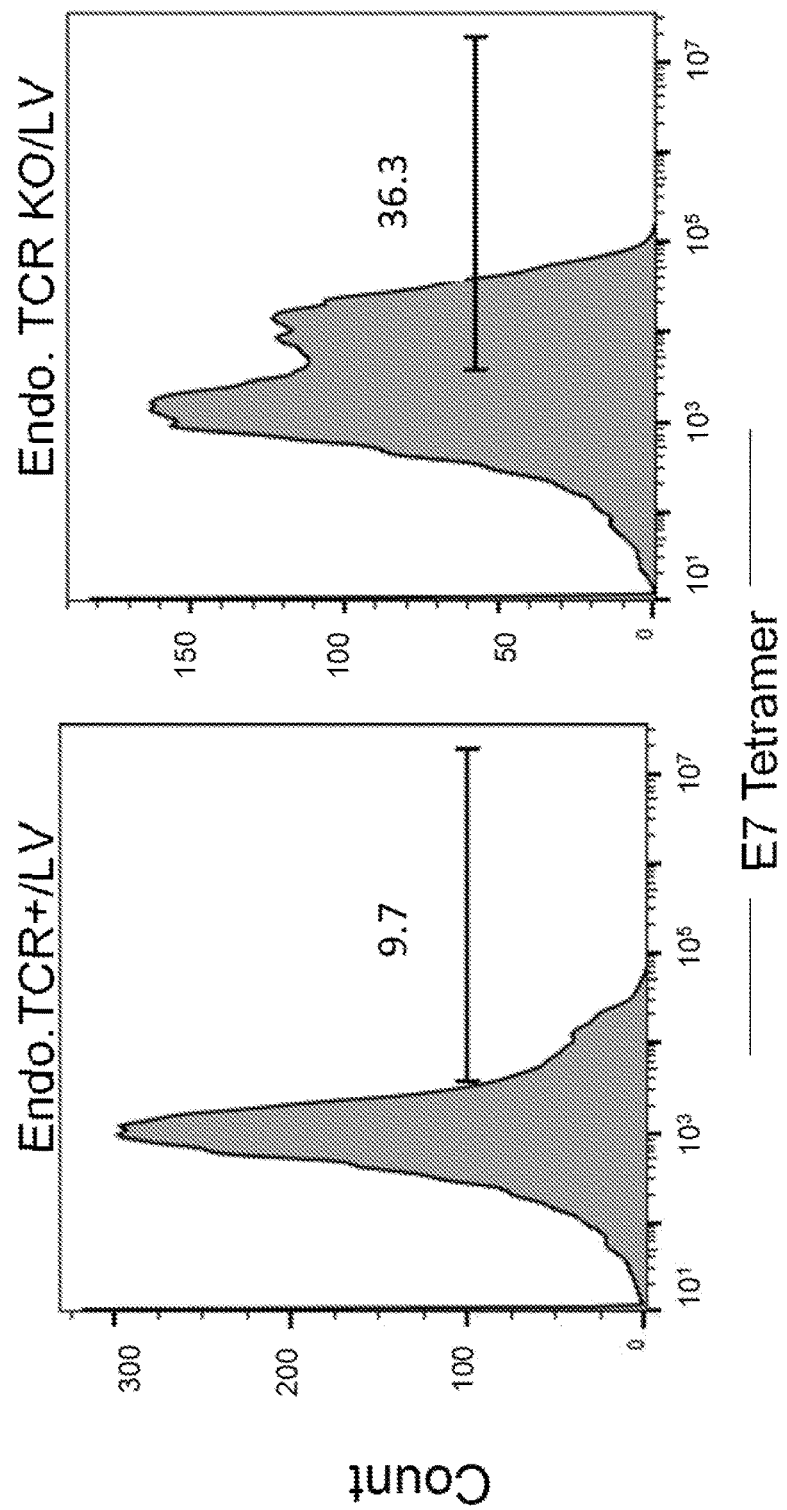
FIG. 10A-10B shows expression of the exemplary TCRs in cells with knock-out of the endogenous TCR genes compared to in cells that retained the endogenous TCR genes, as assessed by E7(11-19) tetramer binding.
Figure 10B:
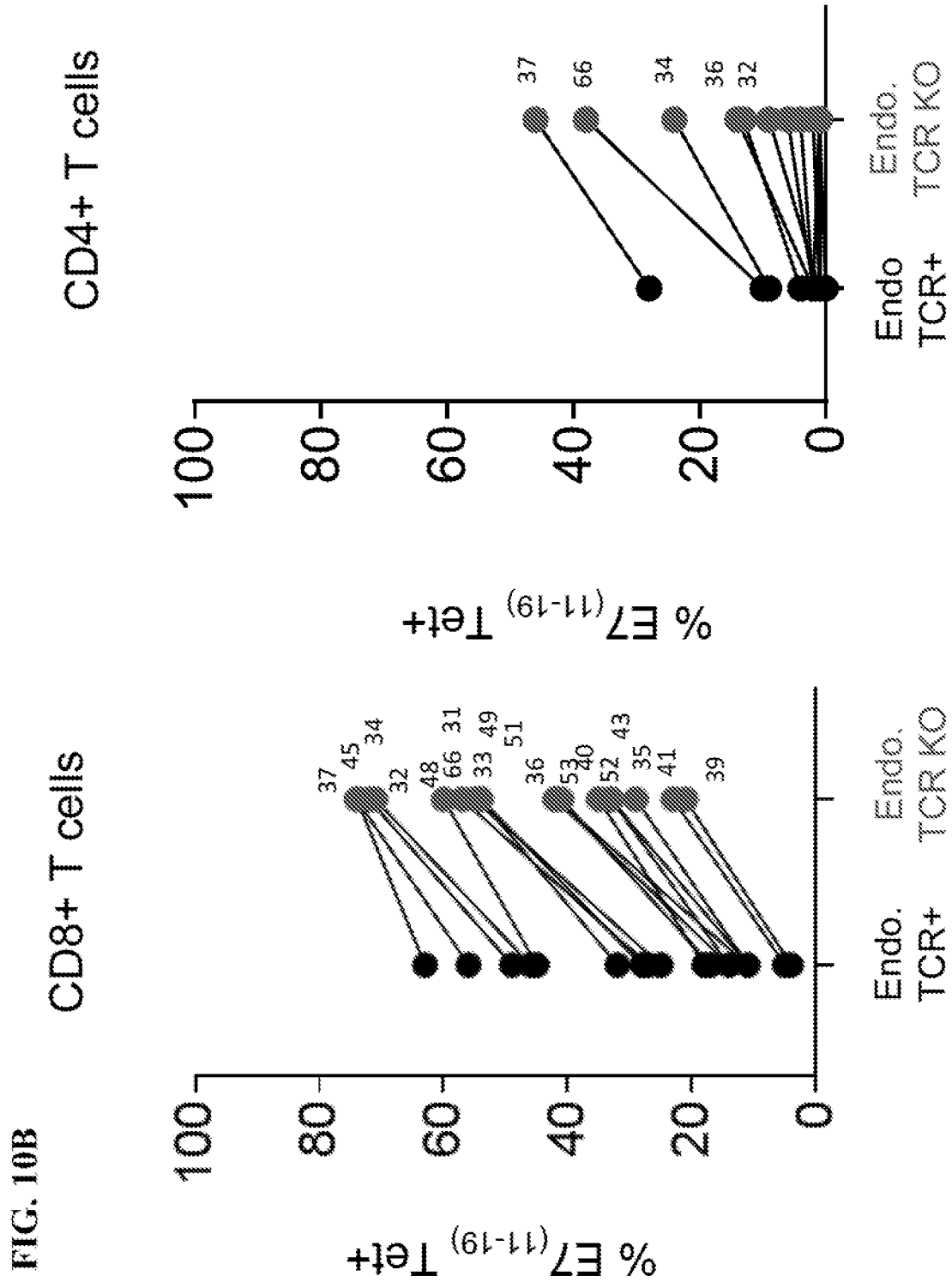

On 6 days after transduction (4 days after electroporation), the cells were assessed by flow cytometry for staining with a labeled MHC tetramer complexed with the HPV16 E7 peptide recognized by the TCR. As shown in FIG. 10A, improved expression of the exemplary TCR36 was observed in CD8+ T cells with knock-out of the endogenous TCR genes (endo. TCR KO/LV), compared to in cells that retained the endogenous TCR genes (endo. TCR+/LV). Other exemplary tested TCRs also were expressed at greater levels, as assessed by E7(11-19) tetramer binding, in endogenous TCR KO CD8+ or CD4+ primary T cells compared to in primary T cells that retained the endogenous TCR genes (endo. TCR+) (FIG. 10B).

Figure 11A:
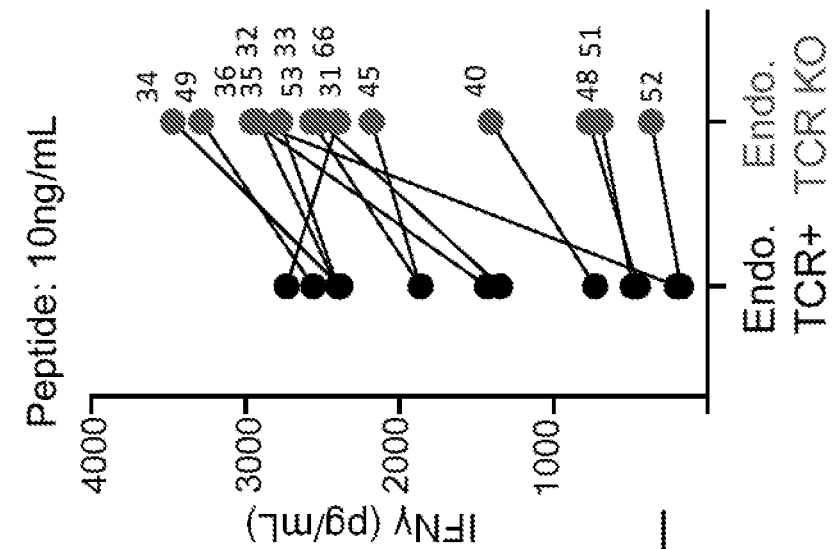
FIG. 11A-11B shows assessment of peptide sensitivity of the exemplary TCRs in cells with knock-out of the endogenous TCR genes compared to in cells that retained the endogenous TCR genes, as assessed by interferon gamma production following incubation with T2 peptide pulsed cells.
Figure 11B:
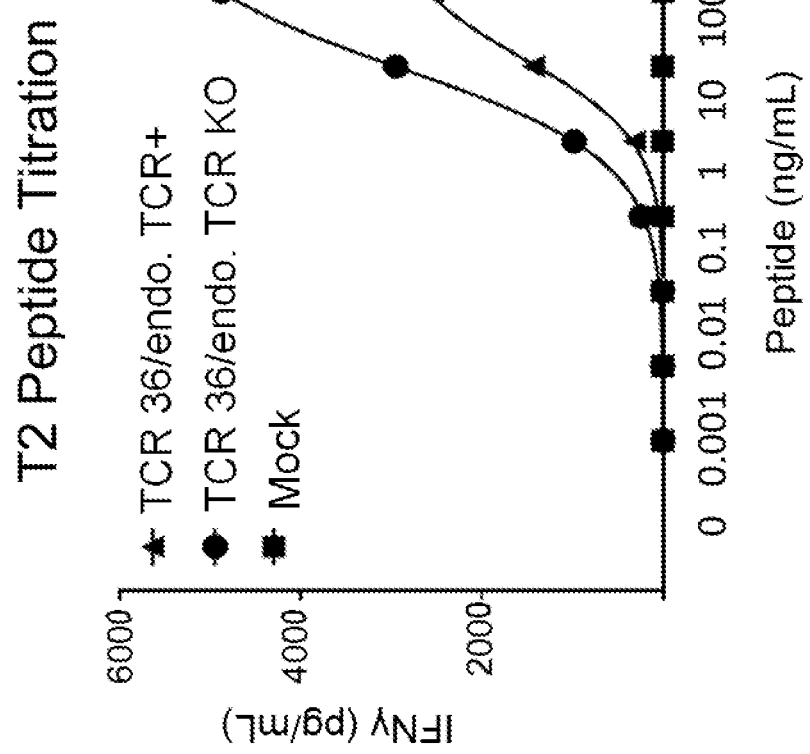

Peptide sensitivity was assessed in endogenous TCR+ or endogenous TCR KO CD8+ primary T cells that were transduced to express the exemplary TCRs, by titrating E7(11-19) peptide onto T2 cells and assessing cytokine production of TCR-expressing cells. Approximately 24 hours after incubation of recombinant TCR-expression cells with T2 target cells pulsed with various concentrations of antigen peptide, interferon gamma was measured in the supernatant. As shown in FIG. 11A, knockout of the endogenous TCR in primary human CD8+_T cells engineered with the exemplary TCR 36 improved peptide sensitivity of the recombinant TCR, consistent with increased expression of the TCR in the cells. Other exemplary TCRs also exhibited improved peptide sensitivity, based on interferon gamma production following incubation with T2 peptide pulsed cells at 10 ng/mL peptide, when expressed in endogenous TCR KO primary human CD8+ T cells compared to endogenous TCR+ primary human CD8+ T cells (FIG. 11B).

Figure 12A:
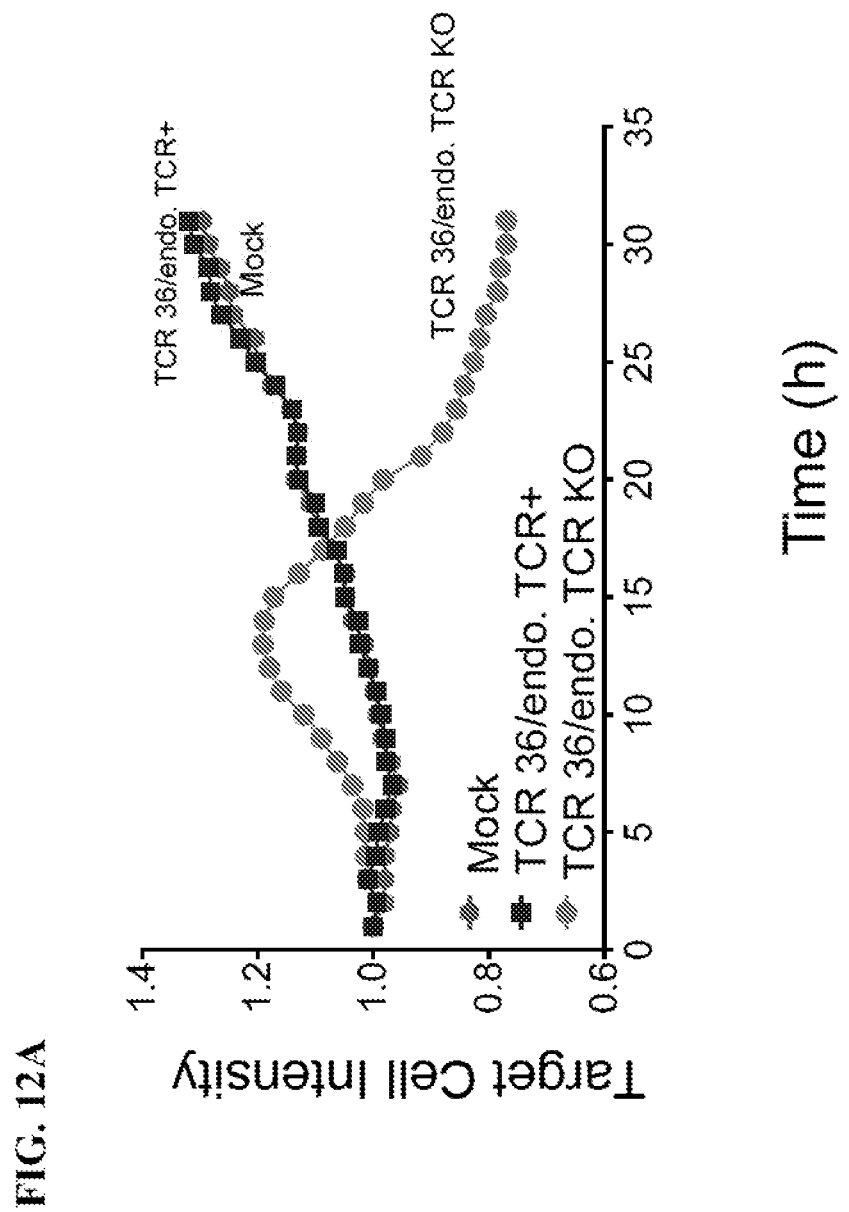
FIG. 12A shows target cell lysis was measured by loss of target every 2 hours using live cell imaging.

To assess function of the recombinant TCRs, cytolytic activity was assessed by incubating recombinant TCR-expressing effector cells with target cells expressing HPV 16 E7 at an effector to target (E:T) of 5:1. Target cell lysis was measured by loss of target every 2 hours using live cell imaging. As shown in FIG. 12A, in CD8+ T cells expressing the exemplary TCR 36, increased target cell lysis was observed in endogenous TCR KO CD8+ primary T cells compared to in endogenous TCR+ CD8+ primary T cells. Other exemplary TCRs also exhibited greater cytolytic activity when expressed in endogenous TCR KO CD8+ primary T cells compared to in CD8+ primary T cells that retained the endogenous TCR genes (endo. TCR+) (FIG. 12B). Interferon gamma cytokine production, monitored following incubation of recombinant TCR-expressing CD8+ effector cells with target cells expressing HPV 16 E7 at an E:T ratio of 5:1 for 48 hours, also was greater in recombinant TCR-expressing cells with knock-out of the endogenous TCR genes (endo. TCR KO) compared to cells that retained the endogenous TCR genes (endo. TCR+) (FIG. 12C).

The results were consistent with an observation that in many of the exemplary recombinant TCRs tested, knock-out of the endogenous TCR resulted in increased expression, peptide sensitivity and function of the exemplary recombinant TCRs.

Example 11: Recombinant TCR-Expressing CD4+ Cell Mediated Anti-Tumor Response

The anti-tumor response of CD4+ and CD8+ cells expressing a recombinant TCR was assessed in a mouse model.

A. Anti-Tumor Response

A mouse model with tumor cells was generated by subcutaneous injection of squamous cell carcinoma cell line UPCI:SCC152 (ATCC® CRL-3240™) cells. Primary CD4+ cells, CD8+ cells or a mixture of CD4+ and CD8+ cells, transduced with a vector encoding a reference TCR capable of binding to HPV E7(11-19) (described in International PCT Publication No. WO 2015/184228; the reference TCR contains a mouse constant region), were administered 39 days after injection of the tumor cells. The mean tumor volume was assessed over time, up to 63 days after injection of the tumor.

Figure 13:
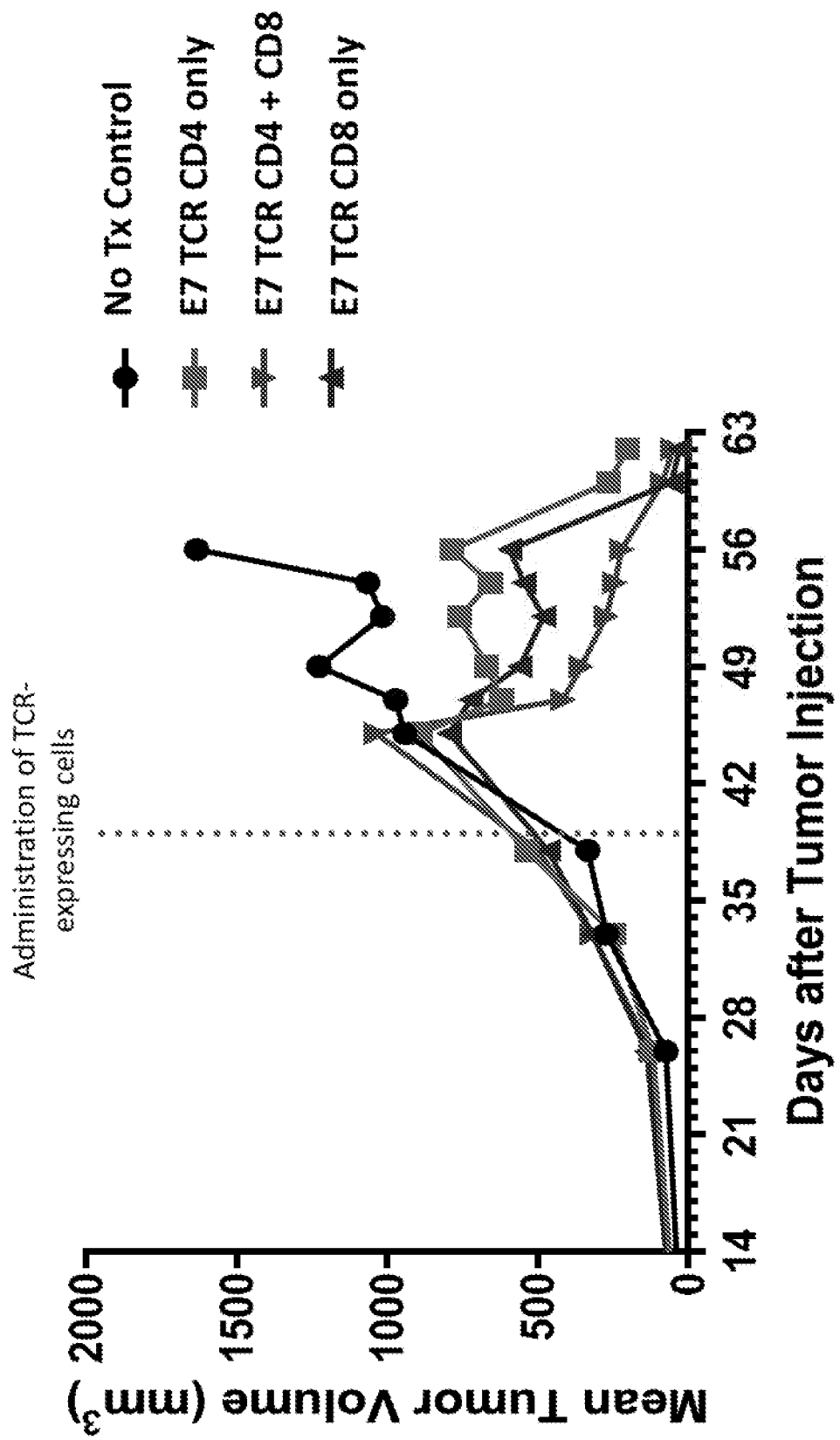
FIG. 13 shows the changes in tumor volume over time in a mouse model with subcutaneous UPCI:SCC152 (ATCC® CRL-3240™) tumors, that were administered CD4+ recombinant TCR-expressing cells alone (inverse triangle), CD8+ recombinant TCR-expressing cells alone (triangle), or a mixture of CD4+ and CD8+ recombinant TCR-expressing cells (square), compared to in mice that did not receive any treatment (circle).

As shown in FIG. 13, tumor volume was reduced in mice administered CD4+ recombinant reference TCR-expressing cells alone (inverse triangle), CD8+ recombinant reference TCR-expressing cells alone (triangle), or a mixture of CD4+ and CD8+ recombinant reference TCR-expressing cells (square), compared to in mice that did not receive any treatment (circle). These results were consistent with an observation that administration of CD4+ recombinant TCR-expressing cells alone contribute to an anti-tumor response, although the effect of administering a combination of CD4+ and CD8+ recombinant TCR-expressing cells was greater.

Example 12: Generation and Assessment of Engineered T Cells Expressing a Recombinant T Cell Receptor (TCR) by Targeted Knock-In or Random Integration of Sequences Encoding the TCR Polynucleotides encoding exemplary recombinant T cell receptors (TCRs) were introduced into T cells with genetic disruption at the endogenous gene loci that encode the T cell receptor alpha (TCRα) chain, by CRISPR/Cas9 mediated gene editing and targeted integration at the site of genetic disruption via homology-dependent repair (HDR), or by random integration via lentiviral transduction.

A. Recombinant TCR Transgene Constructs

Exemplary template polynucleotides were generated for targeted integration by HDR of a transgene containing nucleic acid sequences encoding one of two exemplary recombinant TCRs. The general structure of the exemplary template polynucleotides were as follows: [5' homology arm]-[transgene sequences]-[3' homology arm]. The homology arms included approximately 600 bp of nucleic acid sequences homologous to sequences surrounding the target integration site in exon 1 of the human TCR α constant region (TRAC) gene (5' homology arm sequence set forth in SEQ ID NO:1343; 3' homology arm sequence set forth in SEQ ID NO:1344).

The transgene included nucleic acid sequences encoding the α and β chains of an exemplary recombinant TCR that recognizes an epitope of the human papilloma virus (HPV) 16 oncoprotein E7 (TCR 49), in which the sequences encoding the TCRα and TCRβ chains were separated by a 2A ribosome skip element. The nucleotide sequences encoding TCR 49 also was modified by codon optimization and by mutation(s) to promote the formation of a non-native disulfide bond in the interface between the TCR constant domains to increase pairing and stability of the TCR, as described in Example 4. The non-native disulfide bond was promoted by modifying the TCR chains at residue 48 in the TCR alpha chain constant region (Cα) region from Thr to Cys and residue 57 of the TCR beta chain constant region (Cβ) region from Ser to Cys (see Kuball et al. (2007) Blood, 109:2331-2338).

The transgene also included either a) the human elongation factor 1 alpha (EF1α) promoter to drive the expression of the recombinant TCR-encoding sequences (sequence set forth in SEQ ID NO:1345); or b) sequences encoding a P2A ribosome skip element (sequence set forth in SEQ ID NO:1346) upstream of the recombinant TCR-encoding sequences, to drive expression of the recombinant TCR from the endogenous TCRα locus upon HDR-mediated targeted integration in-frame into the human TCR α constant region (TRAC) gene.

For targeted integration by HDR, adeno-associated virus (AAV) vector constructs containing the template polynucleotides described above were generated. AAV stocks were produced by triple transfection of an AAV vector that included the template polynucleotide, serotype helper plasmid and adenoviral helper plasmid into a 293T cell line. Transfected cells were collected, lysed and AAV stock was collected for transduction of cells.

As control, for random integration, nucleic acid sequences encoding the exemplary recombinant TCR transgene constructs described above, or sequences encoding a reference TCR capable of binding to HPV 16 E7 but containing mouse Cα and the Cβ regions (described in International PCT Publication No. WO 2015/184228), under the control of the EF1α promoter, were incorporated into an exemplary HIV-1 derived lentiviral vector. Pseudotyped lentiviral vector particles were produced by standard procedures by transiently transfecting HEK-293T cells with the resulting vectors, helper plasmids (containing gagpol plasmids and rev plasmid), and a pseudotyping plasmid and used to transduce cells.

B. Generation of Engineered T Cells

Primary human CD4+ and CD8+ T cells from a human donor was isolated by immunoaffinity-based selection from human peripheral blood mononuclear cells (PBMCs) obtained from healthy donors. The isolated CD4+ and CD8+ cells were stimulated for 72 hours at 37° C. by culturing with an anti-CD3/anti-CD28 reagent at a 1:1 bead:cell ratio in media containing human serum, IL-2, IL-7 and IL-15. For introducing a genetic disruption at the endogenous TRAC locus by CRISPR/Cas9-mediated gene editing, the anti-CD3/anti-CD28 reagent was removed, and the cells were electroporated with 2 µM ribonucleoprotein (RNP) complexes containing *Streptococcus pyogenes* Cas9 and a guide RNA (gRNA) with the targeting domain sequence GAGAAUCAAAAUCGGUGAAU (SEQ ID NO:1048), which targets a genetic disruption within exon 1 of the endogenous TCR α constant region (TRAC) gene. Following electroporation, cells were mixed with media containing AAV preparation containing the HDR template polynucleotide encoding the exemplary recombinant TCR under the control of the EF1α promoter for transduction (HDR KO). As controls, cells were treated under the same conditions used for electroporation but without addition of an RNP (mock KO), transduced with a lentiviral vector encoding the recombinant TCR (Lenti), or a reference TCR capable of binding to HPV 16 E7 but containing mouse Cα and the Cβ regions (Lenti Ref), or transduced with a lentiviral vector encoding the recombinant TCR and also electroporated with RNP complexes targeting a genetic disruption at the TRAC locus (Lenti KO). Following transduction, the cells were cultured for approximately 7 days in media containing human serum and IL-2, IL-7 and IL-15.

C. Expression of TCRs

On day 7 after electroporation, the cells were assessed by flow cytometry for staining with an anti-CD3 antibody, an anti-CD4 antibody, an anti-CD8 antibody, an anti-Vbeta22 antibody specific the recombinant TCR, and with a peptide-MHC tetramer complexed with the HPV16 E7 peptide.

The results for TCR 49 expressing CD8+ cells are shown in FIGS. 17A-17C. As shown, the cells expressing TCR 49 by HDR-mediated targeted integration at the TRAC locus exhibited the highest proportion of cells bound by the tetramer (FIG. 17A) and highest mean fluorescence intensity of tetramer staining in CD8+ cells (FIG. 17B). Among the CD8+ cells bound by the tetramer, the extent of binding by the tetramer was generally more uniform in cells that were subjected to HDR-mediated integration compared to random integration by lentiviral transduction, as shown by lower coefficient of variation (the standard deviation of signal within a population of cells divided by the mean of the signal in the respective population; see FIG. 17C).

In another experiment using substantially the same method as described above, staining for the TCR, using the anti Vbeta22 antibody specific for the recombinant TCR or the peptide-MHC tetramer, demonstrated higher expression of TCR49 in CD8+ primary human T cells that were knocked out for the endogenous TCR either by transduction with a lentiviral vector encoding the recombinant TCR and electroporation with RNP complexes targeting a genetic disruption at the TRAC locus (Lenti KO) or by site-directed insertion of the recombinant TCR into the TRAC locus (HDR KO) (FIG. 18A). Assessment of density, as measured using the Bangs Lab method, included labeling single-color fluorescence reference standards for flow cytometry with the same fluorophores used to label cells and generating a calibration curve to associate fluorescence channel values to standardized fluorescence intensity units. Receptor density was determined in relation to the calibration curve. The assessment of density based on tetramer (FIG. 18B) or Vβ22+ (FIG. 18C) demonstrated increased TCR density on T cells in which the recombinant TCR was introduced by site-directed targeted insertion of the recombinant TCR by HDR(HDR KO).

D. Cytolytic Activity and Cytokine Production

Cytolytic activity and cytokine production of cells engineered to express recombinant TCR 49 by HDR or by random integration as described above were assessed after incubating with target cells expressing HPV 16 E7 in vitro.

Cytolytic activity was assessed by culturing recombinant TCR-expressing effector cells with target cells expressing HPV 16 E7 labeled with NucLight Red (NLR) at an effector to target (E:T) ratio of 10:1, 5:1 and 2.5:1. The ability of the T cells to antigen-specifically lyse the target cells was assessed by measuring the loss of labeled target cells every 2 hours up to 44 hours post co-culture. Cytolytic activity was determined from the average from 2 donors in each group, of the area under the curve (AUC) of % killing, normalized to Vbeta expression, and compared to mock transduction control. Cytokine production was measured following incubation of recombinant TCR-expressing effector cells with target cells. Interferon-gamma (IFNγ) and interleukin-2 (IL-2) secretion in the supernatant was determined by ELISA, normalized to Vbeta expression and averaged for the 2 donors in each group.

The results for TCR 49 are shown in FIGS. 19-20, based on results from two independent human donors. The degree of killing and IFNγ secretion was higher in cells in which the recombinant TCR 49 driven by the EF1α promoter was introduced by HDR-mediated targeted integration at the TRAC locus (EF1α-TCR 49 HDR KO), compared to by random integration, with (TCR 49 Lenti) or without knock-out of the TRAC locus (TCR 49 Lenti KO).

E. Conclusion

In general, the results were consistent with the observation that in some cases targeted integration by HDR of nucleic acid sequences encoding the exemplary recombinant TCR resulted in higher recombinant TCR expression of the human TCR in human T cells compared to introduction of the TCR by random integration, thereby leading to higher functional activity of cells expressing the recombinant TCR.

Example 13: Generation and Assessment of Expression of Recombinant T Cell Receptors (TCR) by Targeted Knock-in or Random Integration of Sequences Encoding the TCR in T Cells with Knock-Out of Endogenous TCRα and TCRβ Chains A polynucleotide encoding one of the exemplary recombinant TCR was targeted for integration at one of the sites of genetic disruption via homology-dependent repair (HDR), or was introduced by random integration via lentiviral transduction, in cells engineered to genetically disrupt the endogenous gene loci that encode the T cell receptor alpha (TCRα) or beta (TCRβ) chains or both, by CRISPR/Cas9 mediated gene editing.

For targeted integration by HDR, AAV preparations containing template polynucleotide constructs encoding the exemplary recombinant TCR 49 were generated substantially as described in Example 10, except with the following differences: an additional AAV construct was generated containing the MND promoter (sequence set forth in SEQ ID NO:1347), which is a synthetic promoter that contains the U3 region of a modified MoMuLV LTR with myeloproliferative sarcoma virus enhancer, to control expression of the recombinant TCR-encoding sequences.

For random integration, lentiviral preparations containing nucleic acid sequences encoding the exemplary recombinant TCR 49 (codon optimized and cysteine-modified as described in Example 4; Lenti human) were generated generally as described in Example—10. For these studies, the lentiviral transduction construct further contained a polynucleotide encoding a truncated receptor separated from the recombinant TCR transgene by a sequence encoding a T2A ribosome skip sequence for expression of both the recombinant TCR and the truncated receptor from the same construct; the truncated receptor was for use as a surrogate marker for transduction. As a control, a polynucleotide encoding a chimeric TCR was generated where the Cα and the Cβ of the recombinant TCR were replaced by constant regions from a mouse TCR (mouse Cα sequence set forth in SEQ ID NO:1012; mouse Cβ sequence set forth in SEQ ID NO:1013; Lenti mouse) or the cells were subject to mock transduction (mock transd.).

Primary human CD4+ and CD8+ T cells were isolated and engineered to introduce a genetic disruption at the endogenous TRAC and TRBC loci by CRISPR/Cas9-mediated gene editing and transduced with the AAV preparations containing template polynucleotides for HDR or lentiviral preparations for random integration, generally as described in Example 10B above, except that the cells also were also disrupted at the endogenous TRBC locus (TRAC/TRBC KO, interchangeably designated as TCRαβ KO). Cells were electroporated with ribonucleoprotein (RNP) complexes containing the TRAC-targeting guide RNA (gRNA) described in Example 10B (containing the targeting domain sequence set forth in SEQ ID NO:1048) and an RNP containing a gRNA targeting a consensus target site sequence common to exon 1 of both TCR β constant regions 1 and 2 (with the targeting domain sequence GGCCUCGGCGCUGACGAUCU (SEQ ID NO:1053)). Following electroporation, the cells were mixed with media containing AAV preparations for transduction of exemplary TCR 49 by HDR, under control of EF1α promoter (TCRαβ KO/HDR EF1α) or MND promoter (TCRαβ KO/HDR MND).

As controls, isolated primary CD4+ and CD8+ T cells were transduced with a lentiviral preparation encoding the exemplary recombinant TCR 49 (TCRαβ WT/Lenti human) or the chimeric receptor containing a mouse constant region (TCRαβ WT/Lenti mouse, and treated under the same conditions used for electroporation but without addition of an RNP (Mock KO; also designated as TCRαβ WT or eletro ctrl), or transduced with a lentiviral preparation encoding the exemplary recombinant TCR 49 and subject to electroporation with RNP complexes to knock out TRAC and TRBC loci (TCRαβ KO/Lenti human).

The cells were subsequently cultured for four (4) days, then assessed by flow cytometry for staining with an anti-CD3 antibody, an anti-Vbeta22 antibody that recognizes recombinant TCR 49, and with a peptide-MHC tetramer complexed with the antigen recognized by the recombinant TCR (HPV16 E7 peptide). The cells also were co-stained for CD8 or CD4.

The results are shown in FIGS. 21A-21F. As shown in FIGS. 21A and 21B, CRISPR/Cas9 mediated knockout (KO) of TRAC and TRBC (panel labeled "TCRαβ KO" in figures) resulted in almost complete disruption of TCR expression in CD8+ cells as observed by the absence of CD3 staining in cells subjected to KO and mock transduction (panel labeled TCRαβ KO/mock transd.). Expression of the recombinant TCR (as indicated by cells stained by Vbeta22 antibody or cells positive for tetramer staining among CD8+ cells) was slightly improved following lentiviral transduction in cells that were KO for the endogenous TCR (TCRαβ KO/lenti human) compared to cells that retained expression of the endogenous TCR (TCRαβ WT/lenti human). In cells retaining the endogenous TCR, recombinant TCR expression was improved by lentiviral transduction of a recombinant TCR containing a mouse constant domain compared to lentiviral transduction of a fully human recombinant TCR (compare TCRαβ WT/lenti human and TCRαβ WT/lenti mouse).

HDR-mediated targeted knock-in of the recombinant TCR and KO of the endogenous TCR resulted in a substantially greater proportion of cells expressing the recombinant TCR than observed following lentiviral transduction (first two left panels designated "HDR" compared to TCRαβ KO/lenti human in FIGS. 21A and 21B). The geometric mean fluorescence (gMFI) of recombinant TCR expression, as assessed by Vbeta22 or tetramer staining in CD8+ cells (FIG. 21C) or Vbeta22 staining in CD4+ cells (FIG. 21D), also was substantially higher in cells subjected to HDR compared to lentiviral transduction. The degree of recombinant TCR expression by HDR was similar whether the recombinant TCR was under the control of the EF1α or MND promoter.

Among the cells that were positive for expression of the recombinant TCR, the extent of expression was generally more uniform or tighter in cells that were subjected to HDR-mediated targeted integration compared to random integration lentiviral transduction (see FIGS. 21A and 21B). As shown in FIG. 21E and FIG. 21F, a lower coefficient of variation (the standard deviation of signal within a population of cells divided by the mean of the signal in the respective population) of recombinant TCR expression as determined by peptide-MHC tetramer binding and Vbeta22 expression, respectively, was observed in CD8+ cells that were subjected to HDR-mediated integration compared to random integration. The results are consistent with a finding that targeted knock-in of a recombinant TCR into the endogenous TCRα locus, in combination with knock out of the endogenous TCRαβ chains, results in a higher and a more uniform level of expression in population of cells engineered to express the recombinant TCR compared to other methods.

Example 14: Assessment of HDR-Mediated Knock-In of Sequences Encoding a Recombinant T Cell Receptor (TCR) in T Cells with Knock-Out of Endogenous TCRα or TCRβ Chains or Both To further assess recombinant TCR expression by HDR, nucleic acid sequences encoding an exemplary recombinant TCR into the TRAC locus was targeted for integration in cells containing a dual knock-out of the TRAC and TRBC loci, knock-out of only the TRAC locus or knock-out of only the TRBC locus.

A. Recombinant TCR Transgene Constructs and Generation of Engineered Cells

These studies were carried out using AAV (for HDR) and lentiviral constructs (for random integration) encoding the exemplary TCR 49 (codon optimized and cysteine-modified as described in Example 4) substantially as described in Examples 10 and 11, except with the following differences: lentiviral constructs were generated containing a polynucleotide encoding the recombinant TCR under the operable control of the EF1α or the MND promoter. A lentiviral construct containing a polynucleotide encoding the recombinant TCR 49 under the operable control of the EF1α promoter, and truncated receptor separated from the recombinant TCR transgene by a sequence encoding a T2A ribosome skip sequence, also was generated for comparison.

For targeted integration by HDR, primary human CD4+ and CD8+ T cells were stimulated, cultured and subject to electroporation with ribonucleoprotein (RNP) complexes containing only TRAC-targeting gRNA, only TRBC-targeting gRNA, or a mixture of both RNPs containing TRAC-targeting gRNA and RNPs containing TRBC-targeting gRNA generally as described in Examples 10 and 11 After electroporation, the cells were transduced with AAV preparations containing polynucleotides that encoded the recombinant TCR for targeting to the endogenous TRAC locus, generally as described above.

For random integration, the primary human CD4+ and CD8+ T cells were thawed, stimulated and cultured substantially as described in Examples 10 and 11, followed by transduction with a lentiviral preparation that encoded the recombinant TCR. In this study, the lentivirus preparations were transduced into primary T cells that retained the endogenous TCR. As a control, cells were treated under the same conditions used for lentiviral transduction but without addition of lentivirus (mock transduction).

B. Expression of TCRs

The cells were subsequently cultured for 4-10 additional days, and assessed by flow cytometry after staining with an anti-CD3 antibody, an anti-Vbeta22 antibody specific for the recombinant TCR 49, and with a peptide-MHC tetramer complexed with the antigen recognized by the TCR (HPV16 E7 peptide). The cells also were co-stained for CD8 or CD4.

The results for CD3 staining are shown in FIGS. 22A-22C, for tetramer staining is shown in FIGS. 23A-23C, and for Vbeta22 staining is shown in FIGS. 24A-24D.

As shown in FIGS. 22A and 22C, electroporation with mixtures of RNPs complexed with gRNAs targeting TRAC and RNPs complexed with gRNAs targeting TRBC resulted in efficient knock-out of the endogenous TCR as evidenced by the absence of CD3 surface expression (see panel labeled KO/mock transd. in FIG. 22A; see also group labeled KO mock FIG. 22C, which shows the percentage of CD3+CD8+ cells among CD8+ cells). The degree of KO with RNPs targeting both TRAC and TRBC was greater than for cells electroporated with RNP complexed with gRNA targeting only TRAC or only TRBC, which is consistent with an observation that dual-targeting of both the constant domains of TCR chains α and β improves the efficiency of disrupting endogenous TCR expression. In cells transduced with lentiviral vectors in which no disruption of the endogenous TCR was carried out, CD3 expression was similar in all tested conditions (FIGS. 22B and 22C). As shown in FIGS. 22A and 22C, CD3 expression also was similar among cells in which the recombinant TCR was introduced by HDR, which is consistent with TCR/CD3 surface expression in cells introduced with the recombinant TCR.

As shown in FIGS. 23A and 23C, the proportion of CD8+ cells that bound the peptide-MHC tetramer, indicated recombinant TCR expression, were higher under conditions in which HDR was carried out in cells knocked out for both TRAC and TRBC as compared to TRAC only (compare top and middle rows in FIG. 23A; compare TRAC & TRBC with TRAC only in FIG. 23C). As shown in FIG. 23C, similar results were observed on days 7 and 13. Similar expression of the recombinant TCR was observed in cells whether HDR was carried out with a construct for integration under the control of an exogenous EF1α or MND promoter or under the control of the endogenous TCR promoter (P2A-containing construct). As shown in FIG. 23B and FIG. 23C, fewer cells expressed the recombinant TCR, as assessed by tetramer staining, following lentiviral-mediated transduction, regardless of the presence of a truncated receptor in lentiviral constructs.

As shown in FIGS. 24A-24C, similar to the results above, expression of the recombinant TCR on CD8+ T cells was observed when directly staining for the recombinant TCR with an antibody that specifically recognizes the Vbeta chain of the recombinant TCR. Staining with anti-Vbeta, which also is capable of detecting the recombinant TCR on CD4+ T cells (CD8 negative population), also showed that expression of the recombinant TCR was observed in CD4+ cells (FIG. 24A and FIG. 24D).

For all methods of assessing recombinant TCR expression shown above (anti-CD3, tetramer and anti-Vbeta22), the results above also showed that targeted integration of the recombinant TCR to the TRAC via HDR was specific for nuclease-induced DNA break at the TRAC locus, as the cells electroporated with TRBC-targeting RNP did not express the recombinant TCR (see "TRBC only" condition in FIGs).

C. Cytolytic Activity and Cytokine Production

Cytolytic activity and cytokine production of CD8+ cells engineered to express recombinant TCR 49 by HDR or by random integration as described above were assessed after incubating with target cells expressing HPV 16 E7 in vitro. In addition to cells described above, primary human CD8+ cells transduced with a lentivirus encoding a reference TCR capable of binding to HPV 16 E7 but containing mouse Cα and the Cβ regions, also was assessed.

Cytolytic activity was assessed by incubating recombinant TCR-expressing effector cells with target cells expressing HPV 16 E7 at an effector to target (E:T) ratio of 10:1, 5:1 and 2.5:1. The ability of the T cells to antigen-specifically lyse the target cells was assessed 4 hours post co-culture. Cytolytic activity was determined from the area under the curve (AUC) of % killing, normalized to Vbeta expression and compared to mock transduction control. The results are shown in FIG. 25. The degree of killing was higher in cells in which the recombinant TCR was introduced by HDR-mediated targeted integration compared to by random integration, which is consistent with a finding that higher expression of the recombinant TCR in cells results in higher functional activity.

Cytokine production was also monitored following incubation of recombinant TCR-expressing CD8+ effector cells with target cells expressing HPV 16 E7 at an E:T ratio of 10:1 and 2.5:1 for 48 hours. IFNγ secretion in the supernatant was determined by ELISA and was normalized to Vbeta22 expression for each group. The results are shown in FIG. 26. Similar to the results above for cytolytic activity, a greater production of IFNγ was observed by cells subjected to HDR-mediated integration compared to random integration. In the cytolytic activity assay and assessment of IFNγ secretion, the functional activity of cells expressing the recombinant TCR, by HDR-mediated integration, was similar to the activity of cells expressing, via lentiviral transduction, a reference TCR containing mouse constant domains.

Proliferation of the recombinant TCR-expressing cells was assessed following incubation with SCC152 target cells or T2 target cells pulsed the antigen peptide was assessed. The cells were labeled with CellTrace™ violet (ThermoFisher) dye. Division of live T cells was indicated by CellTrace™ violet dye dilution, as assessed by flow cytometry.

The results of various functional assays are depicted in FIG. 27. As shown in the heat map depicting the relative activity of recombinant TCR-expressing cell populations in various functional activities (AUC of % killing at E:T ratios of 10:1, 5:1 and 2.5:1 (designated "AUC"), tetramer binding in CD8+ cells on days 7 and 13 (designated "tetramer CD8"), proliferation assay (designated "CTV count") using SCC152 cells or T2 target cells pulsed the antigen peptide and secretion of IFNγ from CD8+ cells (designated "CD8 secreted IFNg")), functional activity of cells with recombinant TCR targeted for knock-in at the endogenous TCRα chain constant domain locus and knockout of the endogenous TCRαβ genes or TCRα gene was generally observed to be higher compared to cells where the polynucleotide encoding the recombinant TCR was randomly integrated.

In general, the results were consistent with the observation that targeted integration by HDR results in higher recombinant TCR expression of the human TCR in human T cells compared to introduction of the TCR by random integration, thereby leading to higher functional activity of cells expressing the recombinant TCR.

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

SEQUENCE TABLE

| SEQ ID NO. | SEQUENCE | DESCRIPTION |
|---|---|---|
| 1 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASTF WGQRRTEAFFGQGTRLTVVEDLNKVFPPEVAVFEPSEAEISHTQKATLVCLATGFFPD HVELSWWVNGKEVHSGVCTDPQPLKEQPALNDSRYCLSSRLRVSATFWQNPRNHFR CQVQFYGLSENDEWTQDRAKPVTQIVSAEAWGRADCGFTSVSYQQGVLSATILYEIL LGKATLYAVLVSALVLMAMVKRKDFGSGATNFSLLKQAGDVEENPGPMEKNPLAAP LLILWFHLDCVSSILNVEQSPQSLHVQEGDSTNFTCSFPSSNFYALHWYRWETAKSPE ALFVMTLNGDEKKKGRISATLNTKEGYSYLYIKGSQPEDSATYLCASQTGANNLFFGT GTRLTVIPYIQNPDPAVYQLRDSKSSDKSVCLFTDFDSQTNVSQSKDSDVYITDKCVLD MRSMDFKSNSAVAWSNKSDFACANAFNNSIIPEDTFFPSPESSCDVKLVEKSFETDTNL NFQNLSVIGFRILLLKVAGFNLLMTLRLWSS | TCR 14 Full sequence Cysteine-modified Homo sapiens (aa) |
| 2 | MGTRLLCWVVLGFLGTDHTGAGVSQSPRYKVAKRGQDVALRCDPISGHVSLFWYQQ ALGQGPEFLTYFQNEAQLDKSGLPSDRFFAERPEGSVSTLKIQRTQQEDSAVYLCASSP TGTERELFFGEGSRLTVLEDLKNVFPPEVAVFEPSEAEISHTQKATLVCLATGFYPDHV ELSWWVNGKEVHSGVCTDPQPLKEQPALNDSRYCLSSRLRVSATFWQNPRNHFRCQ VQFYGLSENDEWTQDRAKPVTQIVSAEAWGRADCGFTSESYQQGVLSATILYEILLG KATLYAVLVSALVLMAMVKRKDSRGGSGATNFSLLKQAGDVEENPGPMLLLLVPVL EVIFTLGGTRAQSVTQLDSHVSVSEGTPVLLRCNYSSSYSPSLFWYVQHPNKGLQLLL KYTSAATLVKGINGFEAEFKKSETSFHLTKPSAHMSDAAEYFCVVRGGKLIFGQGTEL SVKPNIQNPDPAVYQLRDSKSSDKSVCLFTDFDSQTNVSQSKDSDVYITDKCVLDMRS MDFKSNSAVAWSNKSDFACANAFNNSIIPEDTFFPSPESSCDVKLVEKSFETDTNLNFQ NLSVIGFRILLLKVAGFNLLMTLRLWSS | TCR 13 Full sequence Cysteine-modified Homo sapiens (aa) |
| 3 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCASTTRS SYEQYFGPGTRLTVTEDLKNVFPPEVAVFEPSEAEISHTQKATLVCLATGFYPDHVELS WWVNGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRGGSGATNFSLLKQAGDVEENPGPMKTFAGFSFLFLW LQLDCMSRGEDVEQSLFLSVREGDSSVINCTYTDSSSTYLYWYKQEPGAGLQLLTYIF SNMDMKQDQRLTVLLNKKDKHLSLRIADTQTGDSAIYFCAVPSGATNKLIFGTGTLL AVQPNIQNPDPAVYQLRDSKSSDKSVCLFTDFDSQTNVSQSKDSDVYITDKCVLDMRS MDFKSNSAVAWSNKSDFACANAFNNSIIPEDTFFPSPESSCDVKLVEKSFETDTNLNFQ NLSVIGFRILLLKVAGFNLLMTLRLWSS | TCR 12/TCR 55 Full sequence Cysteine-modified Homo sapiens (aa) |
| 4 | GGCTCCGGCGCCACAAACTTTTCTCTGCTGAAGCAGGCAGGCGATGTGGAGGAGA ACCCTGGACCA | TCR 14 P2A Artificial (nt) |
| 5 | GGAAGCGGAGCCACCAACTTTTCCCTGCTGAAGCAGGCCGGCGATGTGGAGGAGA ATCCTGGCCCA | TCR 13 P2A Artificial (nt) |

SEQUENCE TABLE

| SEQ ID NO. | SEQUENCE | DESCRIPTION |
|---|---|---|
| 6 | GGATCTGGAGCCACCAACTTCTCCCTGCTGAAGCAGGCCGGCGATGTGGAGGAGA ATCCTGGCCCA | TCR 12 P2A Artificial (nt) |
| 7 | ATGGGCATCCGGCTGCTGTGCAGAGTGGCCTTCTGTTTTCTGGCCGTGGGCCTGGT GGACGTGAAGGTGACCCAGAGCTCCCGGTATCTGGTGAAGAGAACAGGCGAGAA GGTGTTTCTGGAGTGCGTGCAGGACATGGATCACGAGAACATGTTCTGGTACAGG CAGGATCCAGGCCTGGGCCTGAGACTGATCTATTTCAGCTACGATGTGAAGATGA AGGAGAAGGGCGACATCCCTGAGGGCTATTCTGTGAGCAGGGAGAAGAAGGAGC GGTTCAGCCTGATCCTGGAGTCCGCCTCTACCAACCAGACATCTATGTACCTGTGC GCAAGCACCTTCTGGGGACAGAGGAGAACAGAGGCCTTCTTTGGCCAGGGCACCA GGCTGACAGTGGTGGAGGACCTGAATAAGGTGTTCCCCCCTGAGGTGGCCGTGTT TGAGCCATCCGAGGCCGAGATCTCTCACACCCAGAAGGCCACCCTGGTGTGCCTG GCAACCGGCTTCTTTCCCGATCACGTGGAGCTGTCCTGGTGGGTGAACGGCAAGG AGGTGCACTCTGGCGTGTGCACAGACCCACAGCCCCTGAAGGAGCAGCCTGCCCT GAATGATAGCCGCTATTGTCTGTCTAGCAGGCTGCGCGTGTCCGCCACCTTTTGGC AGAACCCAAGGAATCACTTCCGCTGCCAGGTGCAGTTTTACGGCCTGTCCGAGAA TGACGAGTGGACCCAGGATAGGGCCAAGCCAGTGACACAGATCGTGTCTGCCGAG GCATGGGGCAGAGCCGACTGTGGCTTCACCAGCGTGTCCTACCAGCAGGGCGTGC TGAGCGCCACCATCCTGTATGAGATCCTGCTGGGCAAGGCCACACTGTACGCCGT GCTGGTGTCCGCCCTGGTGCTGATGGCCATGGTGAAGCGGAAGGACTTC | TCR 14 - Beta Codon-optimized/ cysteine-modified Homo sapiens (nt) |
| 8 | ATGGGAACCAGGCTGCTGTGCTGGGTGGTGCTGGGCTTTCTGGGAACCGACCACA CAGGAGCAGGCGTGTCCCAGTCTCCAAGGTACAAGGTGGCCAAGAGAGGCCAGG ATGTGGCCCTGAGATGTGACCCCATCTCCGGCCACGTGTCTCTGTTCTGGTACCAG CAGGCCCTGGGACAGGGACCAGAGTTCCTGACATATTTTCAGAACGAGGCCCAGC TGGATAAGAGCGGCCTGCCTTCCGACAGGTTCTTTGCAGAGCGCCCAGAGGGAAG CGTGTCCACCCTGAAGATCCAGAGGACACAGCAGGAGGACTCCGCCGTGTACCTG TGCGCAAGCTCCCCTACCGGAACAGAGAGGGAGCTGTTCTTTGGAGAGGGCAGCC GCCTGACCGTGCTGGAGGATCTGAAGAACGTGTTCCCCCCTGAGGTGGCCGTGTT TGAGCCTAGCGAGGCCGAGATCTCCCACACCCAGAAGGCCACCCTGGTGTGCCTG GCAACCGGCTTCTATCCAGACCACGTGGAGCTGAGCTGGTGGGTGAACGGCAAGGA GGTGCACTCCGGCGTGTGCACAGACCCACAGCCCCTGAAGGAGCAGCCCGCCCTG AATGATAGCCGCTACTGTCTGTCTAGCCGGCTGAGAGTGTCCGCCACCTTTTGGCA GAACCCTAGGAATCACTTCCGCTGCCAGGTGCAGTTTTATGGCCTGTCCGAGAAC GACGAGTGGACCCAGGATCGGGCCAAGCCCGTGACACAGATCGTGTCTGCCGAGG CATGGGGCAGAGCCGATTGTGGCTTCACATCTGAGAGCTACCAGCAGGGCGTGCT GTCCGCCACCATCCTGTACGAGATCCTGCTGGGCAAGGCCACACTGTATGCCGTG CTGGTGAGCGCCCTGGTGCTGATGGCCATGGTGAAGAGGAAGGACTCTAGAGGA | TCR 13 - Beta Codon-optimized/ cysteine-modified Homo sapiens (nt) |
| 9 | ATGGACACCTGGCTGGTGTGCTGGGCCATCTTCAGCCTGCTGAAGGCAGGCCTGA CCGAGCCTGAGGTGACCCAGACACCATCCCACCAGGTGACACAGATGGGCCAGG AAGTGATCCTGCGCTGCGTGCCTATCTCCAACCACCTGTACTTTTATTGGTACAGA CAGATCCTGGGCCAGAAGGTGGAGTTTCTGGTGAGCTTCTACAACAATGAGATCA GCGAGAAGTCCGAGATCTTTGACGATCAGTTCTCTGTGGAGAGGCCCGACGGCAG CAACTTCACCCTGAAGATCCGCTCCACAAAGCTGGAGGATTCTGCCATGTATTTCT GCGCCAGCACCACACGGAGCTCCTACGAGCAGTATTTTGGCCCTGGCACCAGACT GACCGTGACAGAGGACCTGAAGAACGTGTTCCCCCCTGAGGTGGCCGTGTTCGAG CCATCTGAGGCCGAGATCAGCCACACCCAGAAGGCCACCCTGGTGTGCCTGGCAA CCGGCTTCTACCCCGATCACGTGGAGCTGAGCTGGTGGGTGAACGGCAAGGAGGT GCACTCCGGCGTGTGCACAGACCCACAGCCCCTGAAGGAGCAGCCTGCCCTGAAT GATAGCAGATACTGTCTGTCTAGCCGGCTGAGAGTGTCCGCCACCTTCTGGCAGA ACCCAAGGAATCACTTTCGCTGCCAGGTGCAGTTCTATGGCCTGTCTGAGAACGA CGAGTGGACCCAGGATAGGGCCAAGCCAGTGACACAGATCGTGAGCGCCGAGGC ATGGGGCAGAGCCGATTGTGGCTTTACAAGCGAGTCCTATCAGCAGGGCGTGCTG TCCGCCACCATCCTGTACGAGATCCTGCTGGGCAAGGCCACACTGTATGCCGTGCT GGTGTCTGCCCTGGTGCTGATGGCCATGGTGAAGAGGAAGGACTCCAGAGGA | TCR 12 - Beta Codon-optimized/ cysteine-modified Homo sapiens (nt) |
| 10 | ATGGAGAAGAATCCTCTGGCCGCCCCACTGCTGATCCTGTGGTTCCACCTGGACTG CGTGTCCTCTATCCTGAATGTGGAGCAGAGCCCACAGTCCCTGCACGTGCAGGAG GGCGATAGCACCAACTTCACATGTTCCTTTCCTAGCTCCAACTTCTACGCCCTGCA CTGGTACCGGTGGGAGACAGCCAAGAGCCCAGAGGCCCTGTTCGTGATGACACTG AACGGCGACGAGAAGAAGAAGGGCAGAATCAGCGCCACCCTGAATACAAAGGAG GGCTACTCCTATCTGTACATCAAGGGCAGCCAGCCCGAGGATTCCGCCACCTACCT GTGCGCCTCCCAGACAGGCGCCAACAATCTGTTCTTTGGCACCGGCACAAGGCTG ACCGTGATCCCTTATATCCAGAACCCAGACCCTGCCGTGTACCAGCTGAGGGACT CTAAGTCTAGCGATAAGAGCGTGTGCCTGTTCACCGACTTTGATTCTCAGACAAAC GTGAGCCAGAGCAAGGACAGCGACGTGTACATCACCGACAAGTGCGTGCTGGAT ATGAGAAGCATGGACTTTAAGTCCAACTCTGCCGTGGCCTGGTCTAATAAGAGCG ATTTCGCCTGCGCCAACGCCTTTAACAATTCCATCATCCCCGAGGATACATTCTTT CCATCTCCCGAGTCCTCTTGTGACGTGAAGCTGGTGGAGAAGAGCTTCGAGACAG | TCR 14 - Alpha Codon-optimized/ cysteine-modified Homo sapiens (nt) |

SEQUENCE TABLE

| SEQ ID NO. | SEQUENCE | DESCRIPTION |
|---|---|---|
| | ATACAAACCTGAATTTTCAGAACCTGAGCGTGATCGGCTTCCGGATCCTGCTGCTG<br>AAGGTGGCCGGCTTCAATCTGCTGATGACCCTGAGACTGTGGAGCTCCTGA | |
| 11 | ATGCTGCTGCTGCTGGTGCCAGTGCTGGAAGTGATCTTCACCCTGGGAGGAACAA<br>GGGCACAGTCTGTGACCCAGCTGGACAGCCACGTGTCCGTGTCTGAGGGCACACC<br>CGTGCTGCTGAGATGCAACTACTCCTCTAGCTATAGCCCCTCCCTGTTTTGGTACG<br>TGCAGCACCCTAATAAGGGCCTGCAGCTGCTGCTGAAGTATACCTCCGCCGCCAC<br>ACTGGTGAAGGGCATCAATGGCTTCGAGGCCGAGTTTAAGAAGAGCGAGACAAG<br>CTTCCACCTGACAAAGCCTTCCGCCCACATGTCTGACGCCGCCGAGTACTTTTGCG<br>TGGTGCGGGGAGGCAAGCTGATCTTCGGACAGGGAACCGAGCTGAGCGTGAAGC<br>CAAACATCCAGAATCCCGATCTGCCGTGTATCAGCTGCGCGACTCCAAGTCCTCT<br>GATAAGAGCGTGTGCCTGTTCACCGACTTTGATTCTCAGACAAACGTGTCTCAGAG<br>CAAGGACAGCGACGTGTACATCACCGACAAGTGCGTGCTGGATATGCGGAGCATG<br>GACTTTAAGTCCAACTCTGCCGTGGCCTGGTCTAATAAGAGCGATTTCGCCTGCGC<br>CAATGCCTTTAACAATTCCATCATCCCCGAGGATACATTCTTTCCATCTCCCGAGA<br>GCTCCTGTGACGTGAAGCTGGTGGAGAAGAGCTTCGAGACAGATACAAACCTGAA<br>TTTTCAGAACCTGAGCGTGATCGGCTTCAGGATCCTGCTGCTGAAGGTGGCCGGCT<br>TCAATCTGCTGATGACCCTGCGCCTGTGGTCTAGCTGA | TCR 13 - Alpha Codon-optimized/cysteine-modified *Homo sapiens* (nt) |
| 12 | ATGAAGACATTTGCCGGCTTCTCTTTTCTGTTCCTGTGGCTGCAGCTGGATTGCAT<br>GAGCAGGGGCGAGGACGTGGAGCAGAGCCCTTCCTGTCCGTGCGCGAGGGCGA<br>TTCCTCTGTGATCAACTGTACCTACACAGACAGCTCCTCTACCTATCTGTACTGGT<br>ATAAGCAGGAGCCAGGAGCAGGCCTGCAGCTGCTGACCTATATCTTTTCCAACAT<br>GGACATGAAGCAGGATCAGCGGCTGACAGTGCTGCTGAATAAGAAGGACAAGCA<br>CCTGAGCCTGAGAATCGCTGACACCCAGACAGGCGATTCCGCCATCTACTTCTGC<br>GCCGTGCCCTCTGGCGCCACCAATAAGCTGATCTTTGGAACCGGCACACTGCTGG<br>CAGTGCAGCCTAACATCCAGAATCCCGATCCTGCCGTGTACCAGCTGCGGGACAG<br>CAAGAGCTCCGATAAGTCCGTGTGCCTGTTTACCGACTTCGATTCTCAGACAAACG<br>TGTCTCAGAGCAAGGACAGCGACGTGTACATCACCGACAAGTGCGTGCTGGATAT<br>GCGGAGCATGGACTTCAAGTCCAACTCTGCCGTGGCCTGGTCTAATAAGAGCGAC<br>TTTGCCTGCGCCAATGCCTTCAACAATTCCATCATCCCCGAGGATACATTCTTTCC<br>ATCTCCCGAGTCTAGCTGTGACGTGAAGCTGGTGGAGAAGAGCTTCGAGACAGAT<br>ACAAACCTGAATTTCCAGAACCTGTCTGTGATCGGCTTTAGGATCCTGCTGCTGAA<br>GGTGGCCGGCTTTAATCTGCTGATGACCCTGCGCCTGTGGTCCTCTTGA | TCR 12 - Alpha Codon-optimized/cysteine-modified *Homo sapiens* (nt) |
| 13 | ATGGGCATCCGGCTGCTGTGCAGAGTGGCCTTCTGTTTTCTGGCCGTGGGCCTGGT<br>GGACGTGAAGGTGACCCAGAGCTCCCGGTATCTGGTGAAGAGAACAGGCGAGAA<br>GGTGTTTCTGGAGTGCGTGCAGGACATGGATCACGAGAACATGTTCTGGTACAGG<br>CAGGATCCAGGCCTGGGCCTGAGACTGATCTATTTCAGCTACGATGTGAAGATGA<br>AGGAGAAGGGCGACATCCCTGAGGGCTATTCTGTGAGCAGGGAGAAGAAGGAGC<br>GGTTCAGCCTGATCCTGGAGTCCGCCTCTACCAACCAGACATCTATGTACCTGTGC<br>GCAAGCACCTTCTGGGGACAGAGGGAGAACAGAGGCCTTCTTTGGCCAGGGCACCA<br>GGCTGACAGTGGTGGAGGACCTGAATAAGGTGTTCCCCCCTGAGGTGGCCGTGTT<br>TGAGCCATCCGAGGCCGAGATCTCTCACACCCAGAAGGCCACCCTGGTGTGCCTG<br>GCAACCGGCTTCTTTCCCGATCACGTGGAGCTGTCCTGGTGGGTGAACGGCAAGG<br>AGGTGCACTCGGCGTGTGCACAGACCCACAGCCCCTGAAGGAGCAGCCTGCCCT<br>GAATGATAGCCGCTATTGTCTGTCTAGCAGGCTGCGCGTGTCCGCCACCTTTTGGC<br>AGAACCCAAGGAATCACTTCCGCTGCCAGGTGCAGTTTTACGGCCTGTCCGAGAA<br>TGACGAGTGGACCCAGGATAGGGCCAAGCCAGTGACACAGATCGTGTCTGCCGAG<br>GCATGGGCAGAGCCGACTGTGCTTCACCAGCGTGTCCTACCAGCAGGCGTGC<br>TGAGCGCCACCATCCTGTATGAGATCCTGCTGGGCAAGGCCACACTGTACGCCGT<br>GCTGGTGTCCGCCCTGGTGCTGATGGCCATGGTGAAGCGGAAGGACTTCGGCTCC<br>GGCGCCACAAACTTTTCTCTGCTGAAGCAGGCAGGCGATGTGGAGGAGAACCCTG<br>GACCAATGGAGAAGAATCCTGGCCGCCACTGCTGATCCTGTGGTTCCACCTG<br>GACTGCGTGTCCTCTATCCTGAATGTGGAGAGACCCACAGTCCCTGCACGTGC<br>AGGAGGGCGATAGCACCAACTTCACATGTTCCTTTCCTAGCTCCAACTTCTACGCC<br>CTGCACTGGTACCGGTGGGAGACAGCCAAGAGCCCAGAGGCCCTGTTCGTGATGA<br>CACTGAACGGCGACGAGAAGAAGAAGGGCAGAATCAGCGCCACCCTGAATACAA<br>AGGAGGGCTACTCCTATCTGTACATCAAGGGCAGCCAGCCCGAGGATTCCGCCAC<br>CTACCTGTGCGCCTCCCAGACAGGCGCCAACAATCTGTTCTTTGGCACCGGCACAA<br>GGCTGACCGTGATCCCTTATATCCAGAACCCAGACCCTGCCGTGTACCAGCTGAG<br>GGACTCTAAGTCTAGCGATAAGAGCGTGTGCCTGTTCACCGACTTTGATTCTCAGA<br>CAAACGTGAGCCAGAGCAAGGACAGCGACGTGTACATCACCGACAAGTGCGTGC<br>TGGATATGCGAAGCATGGACTTTAAGTCCAACTCTGCCGTGGCCTGGTCTAATAA<br>GAGCGATTTCGCCTGCGCCAACGCCTTTAACAATTCCATCATCCCCGAGGATACAT<br>TCTTTCCATCTCCCGAGTCCTCTTGTGACGTGAAGCTGGTGGAGAAGAGCTTCGAG<br>ACAGATACAAACCTGAATTTTCAGAACCTGAGCGTGATCGGCTTCCGGATCCTGCT<br>GCTGAAGGTGGCCGGCTTCAATCTGCTGATGACCCTGAGACTGTGGAGCTCCTGA | TCR 14 Codon-optimized/cysteine-modified full sequence *Homo sapiens* (nt) |

-continued

SEQUENCE TABLE

| SEQ ID NO. | SEQUENCE | DESCRIPTION |
| --- | --- | --- |
| 14 | ATGGGAACCAGGCTGCTGTGCTGGGTGGTGCTGGGCTTTCTGGGAACCGACCACA<br>CAGGAGCAGGCGTGTCCCAGTCTCCAAGGTACAAGGTGGCCAAGAGAGGCCAGG<br>ATGTGGCCCTGAGATGTGACCCCATCTCCGGCCACGTGTCTCTGTTCTGGTACCAG<br>CAGGCCCTGGGACAGGGACCAGAGTTCCTGACATATTTTCAGAACGAGGCCCAGC<br>TGGATAAGAGCGGCCTGCCTTCCGACAGGTTCTTTGCAGAGCGCCCAGAGGGAAG<br>CGTGTCCACCCTGAAGATCCAGAGGACACAGCAGGAGGACTCCGCCGTGTACCTG<br>TGCGCAAGCTCCCCTACCGGAACAGAGAGGGAGCTGTTCTTTGGAGAGGGCAGCC<br>GCCTGACCGTGCTGGAGGATCTGAAGAACGTGTTCCCCCCTGAGGTGGCCGTGTTT<br>GAGCCTAGCGAGGCCGAGATCTCCCACACCCAGAAGGCCACCCTGGTGTGCCTGG<br>CAACCGGCTTCTATCCAGACCACGTGGAGCTGAGCTGGTGGGTGAACGGCAAGGA<br>GGTGCACTCCGGCGTGTGCACAGACCCACAGCCCCTGAAGGAGCAGCCCGCCCTG<br>AATGATAGCCGCTACTGTCTGTCTAGCCGGCTGAGAGTGTCCGCCACCTTTTGGCA<br>GAACCCTAGGAATCACTTCCGCTGCCAGGTGCAGTTTTATGGCCTGTCCGAGAAC<br>GACGAGTGGACCCAGGATCGGGCAAGCCCGTGACACAGATCGTGTCTGCCGAGG<br>CATGGGGCAGAGCCGATTGTGGCTTCACATCTGAGAGCTACCAGCAGGGCGTGCT<br>GTCCGCCACCATCCTGTACGAGATCCTGCTGGGCAAGGCCACACTGTATGCCGTG<br>CTGGTGAGCGCCCTGGTGCTGATGGCCATGGTGAAGAGGAAGGACTCTAGAGGAG<br>GAAGCGGAGCCACCAACTTTTCCCTGCTGAAGCAGGCCGGCGATGTGGAGGAGAA<br>TCCTGGCCCAATGCTGCTGCTGCTGGTGCCAGTGCTGGAAGTGATCTTCACCCTGG<br>GAGGAACAAGGGCACAGTCTGTGACCCAGCTGGACAGCACGTGTCCGTGTCTGA<br>GGGCACACCCGTGCTGCTGAGATGCAACTACTCCTCTAGCTATAGCCCCTCCCTGT<br>TTTGGTACGTGCAGCACCCTAATAAGGGCCTGCAGCTGCTGCTGAAGTATACCTCC<br>GCCGCCACACTGGTAAGGGCATCAATGGCTTCGAGGCCGAGTTTAAGAAGAGCG<br>AGACAAGCTTCCACCTGACAAAGCCTTCCGCCCACATGTCTGACGCCGCCGAGTA<br>CTTTTGCGTGGTGCGGGAGGCAAGCTGATCTTCGGACAGGGAACCGAGCTGAGC<br>GTGAAGCCAAACATCCAGAATCCCGATCCTGCCGTGTATCAGCTGCGCGACTCCA<br>AGTCCTCTGATAAGAGCGTGTGCCTGTTCACCGACTTTGATTCTCAGACAAACGTG<br>TCTCAGAGCAAGGACAGCGACGTGTACATCACCGACAAGTGCGTGCTGGATATGC<br>GGAGCATGGACTTTAAGTCCAACTCTGCCGTGGCCTGGTCTAATAAGAGCGATTTC<br>GCCTGCGCCAATGCCTTTAACAATTCCATCATCCCCGAGGATACATTCTTTCCATC<br>TCCCGAGAGCTCCTGTGACGTGAAGCTGGTGGAGAAGAGCTTCGAGACAGATACA<br>AACCTGAATTTTCAGAACCTGAGCGTGATCGGCTTCAGGATCCTGCTGCTGAAGGT<br>GGCCGGCTTCAATCTGCTGATGACCCTGCGCCTGTGGTCTAGCTGA | TCR 13 Codon-<br>optimized/<br>cysteine-modified<br>full sequence<br>Homo sapiens<br>(nt) |
| 15 | ATGGACACCTGGCTGGTGTGCTGGGCCATCTTCAGCCTGCTGAAGGCAGGCCTGA<br>CCGAGCCTGAGGTGACCCAGACACCATCCCACCAGGTGACACAGATGGGCCAGG<br>AAGTGATCCTGCGGTGCGTGCCTATCTCCAACCACCTGTACTTTTATTGGTACAGA<br>CAGATCCTGGGCCAGAAGGTGGAGTTTCTGGTGAGCTTCTACAACAATGAGATCA<br>GCGAGAAGTCCGAGATCTTTGACGATCAGTTCTCTGTGGAGAGGCCCGACGGCAG<br>CAACTTCACCCTGAAGATCCGCTCCACAAAGCTGGAGGATTCTGCCATGTATTTCT<br>GCGCCAGCACCACACGGAGCTCCTACGAGCAGTATTTTGGCCCTGGCACCAGACT<br>GACCGTGACAGAGGACCTGAAGAACGTGTTCCCCCCTGAGGTGGCCGTGTTCGAG<br>CCATCTGAGGCCGAGATCAGCCACACCCAGAAGGCCACCCTGGTGTGCCTGGCAA<br>CCGGCTTCTACCCCGATCACGTGGAGCTGAGCTGGTGGGTGAACGGCAAGGAGGT<br>GCACTCCGGCGTGTGCACAGACCCACAGCCCCTGAAGGAGCAGCCTGCCCTGAAT<br>GATAGCAGATACTGTCTGTCTAGCCGGCTGAGAGTGTCCGCCACCTTCTGGCAGA<br>ACCCAAGGAATCACTTTCGCTGCCAGGTGCAGTTCTATGCCTGTCTGAGAACGA<br>CGAGTGGACCCAGGATAGGGCCAAGCCAGTGACACAGATCGTGAGCGCCGAGGC<br>ATGGGGCAGAGCCGATTGTGGCTTTACAAGCGAGTCCTATCAGCAGGGCGTGCTG<br>TCCGCCACCATCCTGTACGAGATCCTGCTGGGCAAGGCCACACTGTATGCCGTGCT<br>GGTGTCTGCCCTGGTGCTGATGGCCATGGTGAAGAGGAAGGACTCCAGAGGAGGA<br>TCTGGAGCCACCAACTTCTCCCTGCTGAAGCAGGCCGGCGATGTGGAGGAGAATC<br>CTGGCCCAATGAAGACATTTGCCGGCTTCTCTTTTCTGTTCCTGTGGCTGCAGCTG<br>GATTGCATGAGCAGGGCGAGGACGTGGAGCAGAGCCTGTTCCTGTCCGTGCGCG<br>AGGGCGATTCCTCTGTGATCAACTGTACCTACACAGACAGCTCCTCTACCTATCTG<br>TACTGGTATAAGCAGGAGCCAGGAGCAGGCCTGCAGCTGCTGACCTATATCTTTT<br>CCAACATGGACATGAAGCAGGATCAGCGGCTGACAGTGCTGCTGAATAAGAAGG<br>ACAAGCACCTGAGCCTGAGAATCGCTGACACCCAGACAGGCGATTCCGCCATCTA<br>CTTCTGCGCCGTGCCCTCTGGCGCCACCAATAAGCTGATCTTTGGAACCGGCACAC<br>TGCTGGCAGTGCAGCCTAACATCCAGAATCCCGATCCTGCCGTGTACCAGCTGCG<br>GGACAGCAAGAGCTCCGATAAGTCCGTGTGCCTGTTTACCGACTTCGATTCTCAGA<br>CAAACGTGTCTCAGAGCAAGGACAGCGACGTGTACATCACCGACAAGTGCGTGCT<br>GGATATGCGGAGCATGGACTTCAAGTCCAACTCTGCCGTGGCCTGGTCTAATAAG<br>AGCGACTTTGCCTGCGCCAATGCCTTCAACAATTCCATCATCCCCGAGGATACATT<br>CTTTCCATCTCCCGAGTCTAGCTGTGACGTGAAGCTGGTGGAGAAGAGCTTCGAG<br>ACAGATACAAACCTGAATTTCCAGAACCTGTCTGTGATCGGCTTTAGGATCCTGCT<br>GCTGAAGGTGGCCGGCTTTAATCTGCTGATGACCCTGCGCCTGTGGTCCTCTTGA | TCR 12<br>Codon-optimized/<br>cysteine-modified<br>full sequence<br>Homo sapiens<br>(nt) |

| SEQ ID NO. | SEQUENCE | DESCRIPTION |
| --- | --- | --- |
| 16 | ATGGGAATCAGGCTCCTCTGTCGTGTGGCCTTTTGTTTCCTGGCTGTAGGCCTCGT<br>AGATGTGAAAGTAACCCAGAGCTCGAGATATCTAGTCAAAAGGACGGGAGAGAA<br>AGTTTTTCTGGAATGTGTCCAGGATATGGACCATGAAAATATGTTCTGGTATCGAC<br>AAGACCCAGGTCTGGGGCTACGGCTGATCTATTTCTCATATGATGTTAAAATGAA<br>AGAAAAAGGAGATATTCCTGAGGGGTACAGTGTCTCTAGAGAAGAAGGAGCG<br>CTTCTCCCTGATTCTGGAGTCCGCCAGCACCAACCAGACATCTATGTACCTCTGTG<br>CCAGCACCTTCTGGGGACAGCGAAGGACTGAAGCTTTCTTTGGACAAGGCACCAG<br>ACTCACAGTTGTAGAGGACCTGAACAAGGTGTTCCCACCCGAGGTCGCTGTGTTT<br>GAGCCATCAGAAGCAGAGATCTCCCACACCCAAAAGGCCACACTGGTGTGCCTGG<br>CCACAGGCTTCTTCCCTGACCACGTGGAGCTGAGCTGGTGGGTGAATGGGAAGGA<br>GGTGCACAGTGGGGTCAGCACGGACCCGCAGCCCCTCAAGGAGCAGCCCGCCCTC<br>AATGACTCCAGATACTGCCTGAGCAGCCGCCTGAGGGTCTCGGCCACCTTCTGGC<br>AGAACCCCGCAACCACTTCCGCTGTCAAGTCCAGTTCTACGGGCTCTCGGAGAA<br>TGACGAGTGGACCCAGGATAGGGCCAAACCCGTCACCCAGATCGTCAGCGCCGAG<br>GCCTGGGGTAGAGCAGACTGTGGCTTTACCTCGGTGTCCTACCAGCAAGGGGTCC<br>TGTCTGCCACCATCCTCTATGAGATCCTGCTAGGGAAGGCCACCCTGTATGCTGTG<br>CTGGTCAGCGCCCTTGTGTTGATGGCCATGGTCAAGAGAAAGGATTTCTGA | TCR 14 - Beta<br>Native<br>*Homo sapiens*<br>(nt) |
| 17 | ATGGGCACCAGGCTCCTCTGCTGGGTGGTCCTGGGTTTCCTAGGGACAGATCACA<br>CAGGTGCTGGAGTCTCCCAGTCCCCTAGGTACAAAGTCGCAAAGAGAGGACAGGA<br>TGTAGCTCTCAGGTGTGATCCAATTTCGGGTCATGTATCCCTTTTTTGGTACCAAC<br>AGGCCCTGGGGCAGGGGCCAGAGTTTCTGACTTATTTCCAGAATGAAGCTCAACT<br>AGACAAATCGGGGCTGCCCAGTGATCGCTTCTTTTGCAGAAAGGCCTGAGGGATCC<br>GTCTCCACTCTGAAGATCCAGCGCACACAGCAGGAGGACTCCGCCGTGTATCTCT<br>GTGCCAGCAGCCCGACAGGGACTGAGAGGGAGCTGTTTTTTGGAGAAGGCTCTAG<br>GCTGACCGTACTGGAGGACCTGAAAAACGTGTTCCCACCCGAGGTCGCTGTGTTT<br>GAGCCATCAGAAGCAGAGATCTCCCACACCCAAAAGGCCACACTGGTGTGCCTGG<br>CCACAGGCTTCTACCCCGACCACGTGGAGCTGAGCTGGTGGGTGAATGGGAAGGA<br>GGTGCACAGTGGGGTCAGCACAGACCCGCAGCCCCTCAAGGAGCAGCCCGCCCTC<br>AATGACTCCAGATACTGCCTGAGCAGCCGCCTGAGGGTCTCGGCCACCTTCTGGC<br>AGAACCCCGCAACCACTTCCGCTGTCAAGTCCAGTTCTACGGGCTCTCGGAGAA<br>TGACGAGTGGACCCAGGATAGGGCCAAACCTGTCACCCAGATCGTCAGCGCCGAG<br>GCCTGGGGTAGAGCAGACTGTGGCTTCACCTCCGAGTCTTACCAGCAAGGGGTCC<br>TGTCTGCCACCATCCTCTATGAGATCTTGCTAGGGAAGGCCACCTTGTATGCCGTG<br>CTGGTCAGTGCCCTCGTGCTGATGGCCATGGTCAAGAGAAAGGATTCCAGAGGCT<br>AG | TCR 13 - Beta<br>Native<br>*Homo sapiens*<br>(nt) |
| 18 | AQKITQTQPGMFVQEKEAVTLDCTYDTSDQSYGLFWYKQPSSGEMIFLIYQGSYDEQ<br>NATEGRYSLNFQKARKSANLVISASQLGDSAMYFCAMREGRGFKTIFGAGTRLFVKA<br>NIQKPDPAVYQLRDSKSSDKSVCLFTDFDSQTNVSQSKDSDVYITDKTVLDMRSMDF<br>KSNSAVAWSNKSDFACANAFNNSIIPADTFFPSPESSCDVKLVEKSFETDTNLNFQNLS<br>VIGFRILLLKVAGFNLLMTLRLWSS | TCR 3 - Alpha<br>Native<br>*Homo sapiens*<br>(aa) |
| 19 | AQKITQTQPGMFVQEKEAVTLDCTYDTSDQSYGLFWYKQPSSGEMIFLIYQGSYDEQ<br>NATEGRYSLNFQKARKSANLVISASQLGDSAMYFCAMREGRGFKTIFGAGTRLFVKA<br>NIQKPDPAVYQLRDSKSSDKSVCLFTDFDSQTNVSQSKDSDVYITDKCVLDMRSMDF<br>KSNSAVAWSNKSDFACANAFNNSIIPADTFFPSPESSCDVKLVEKSFETDTNLNFQNLS<br>VIGFRILLLKVAGFNLLMTLRLWSS | TCR 3 - Alpha<br>Cysteine-<br>modified<br>*Homo sapiens*<br>(aa) |
| 20 | ATGTCACTTTCTAGCCTGCTGAAGGTGGTCACAGCTTCACTGTGGCTAGGACCTGG<br>CATTGCCCAGAAGATAACTCAAACCCAACCAGGAATGTTCGTGCAGGAAAAGGA<br>GGCTGTGACTCTGGACTGCACATATGACACCAGTGATCAAAGTTATGGTCTCTTCT<br>GGTACAAGCAGCCCAGCAGTGGGGAAATGATTTTTCTTATTTATCAGGGGTCTTAT<br>GACGAGCAAAATGCAACAGAAGGTCGCTACTCATTGAATTTCCAGAAGGCAAGA<br>AAATCCGCCAACCTTGTCATCTCCGCTTCACAACTGGGGGACTCAGCAATGTATTT<br>CTGTGCAATGAGAGAGGGGGCGAGGCTTCAAAACTATCTTTGGAGCAGGAACAAG<br>ACTATTTGTTAAAGCAAATATCCAGAAGCCTGACCCTGCCGTGTACCAGCTGAGA<br>GACTCTAAATCCAGTGACAAGTCTGTCTGCCTATTCACCGATTTTGATTCTCAAAC<br>AAATGTGTCACAAAGTAAGGATTCTGATGTGTATATCACAGACAAAACTGTGCTA<br>GACATGAGGTCTATGGACTTCAAGAGCAACAGTGCTGTGGCCTGGAGCAACAAAT<br>CTGACTTTGCATGTGCAAACGCCTTCAACAACAGCATTATTCCAGCAGACACCTTC<br>TTCCCCAGCCCAGAAAGTTCCTGTGATGTCAAGCTGGTCGAGAAAAGCTTTGAAA<br>CAGATACGAACCTAAACTTTCAAAACCTGTCAGTGATTGGGTTCCGAATCCTCCTC<br>CTGAAAGTGGCCGGGTTTAATCTGCTCATGACGCTGCGGCTG | TCR 3 - Alpha<br>Native<br>*Homo sapiens*<br>(nt) |
| 21 | ATGTCACTTTCTAGCCTGCTGAAGGTGGTCACAGCTTCACTGTGGCTAGGACCTGG<br>CATTGCCCAGAAGATAACTCAAACCCAACCAGGAATGTTCGTGCAGGAAAAGGA<br>GGCTGTGACTCTGGACTGCACATATGACACCAGTGATCAAAGTTATGGTCTCTTCT<br>GGTACAAGCAGCCCAGCAGTGGGGAAATGATTTTTCTTATTTATCAGGGGTCTTAT<br>GACGAGCAAAATGCAACAGAAGGTCGCTACTCATTGAATTTCCAGAAGGCAAGA<br>AAATCCGCCAACCTTGTCATCTCCGCTTCACAACTGGGGGACTCAGCAATGTATTT<br>CTGTGCAATGAGAGAGGGGCGAGGCTTCAAAACTATCTTTGGAGCAGGAACAAG | TCR 3 - Alpha<br>Codon-optimized/<br>cysteine-modified<br>*Homo sapiens*<br>(nt) |

| SEQ ID NO. | SEQUENCE | DESCRIPTION |
|---|---|---|
| | ACTATTTGTTAAAGCAAATATCCAGAAGCCTGACCCTGCCGTGTACCAGCTGAGA<br>GACTCTAAATCCAGTGACAAGTCTGTCTGCCTATTCACCGATTTTGATTCTCAAAC<br>AAATGTGTCACAAAGTAAGGATTCTGATGTGTATATCACAGACAAATGTGTGCTA<br>GACATGAGGTCTATGGACTTCAAGAGCAACAGTGCTGTGGCCTGGAGCAACAAAT<br>CTGACTTTGCATGTGCAAACGCCTTCAACAACAGCATTATTCCAGCAGACACCTTC<br>TTCCCCAGCCCAGAAAGTTCCTGTGATGTCAAGCTGGTCGAGAAAAGCTTTGAAA<br>CAGATACGAACCTAAACTTTCAAAACCTGTCAGTGATTGGGTTCCGAATCCTCCTC<br>CTGAAAGTGGCCGGGTTTAATCTGCTCATGACGCTGCGGCTGTGGTCTTCC | |
| 22 | GAGVSQSPRYKVAKRGQDVALRCDPISGHVSLFWYQQALGQGPEFLTYFQNEAQLD<br>KSGLPSDRFFAERPEGSVSTLKIQRTQQEDSAVYLCASSHLAGFTGELFFGEGSRLTVL<br>EDLKNVFPPEVAVFEPSEAEISHTQKATLVCLATGFYPDHVELSWWVNGKEVHSGVS<br>TDPQPLKEQPALNDSRYCLSSRLRVSATFWQNPRNHFRCQVQFYGLSENDEWTQDRA<br>KPVTQIVSAEAWGRADCGFTSESYQQGVLSATILYEILLGKATLYAVLVSALVLMAM<br>VKRKDSRG | TCR 3 - Beta<br>Native<br>Homo sapiens<br>(aa) |
| 23 | GAGVSQSPRYKVAKRGQDVALRCDPISGHVSLFWYQQALGQGPEFLTYFQNEAQLD<br>KSGLPSDRFFAERPEGSVSTLKIQRTQQEDSAVYLCASSHLAGFTGELFFGEGSRLTVL<br>EDLKNVFPPEVAVFEPSEAEISHTQKATLVCLATGFYPDHVELSWWVNGKEVHSGVC<br>TDPQPLKEQPALNDSRYCLSSRLRVSATFWQNPRNHFRCQVQFYGLSENDEWTQDRA<br>KPVTQIVSAEAWGRADCGFTSESYQQGVLSATILYEILLGKATLYAVLVSALVLMAM<br>VKRKDSRG | TCR 3 - Beta<br>Cysteine-<br>modified<br>Homo sapiens<br>(aa) |
| 24 | ATGGGCACCAGGCTCCTCTGCTGGGTGGTCCTGGGTTTCCTAGGGACAGATCACA<br>CAGGTGCTGGAGTCTCCCAGTCCCCTAGGTACAAAGTCGCAAAGAGAGGACAGGA<br>TGTAGCTCTCAGGTGTGATCCAATTTCGGGTCATGTATCCCTTTTTTGGTACCAAC<br>AGGCCCTGGGGCAGGGGCCAGAGTTTCTGACTTATTTCCAGAATGAAGCTCAACT<br>AGACAAATCGGGGCTGCCCAGTGATCGCTTCTTTTGCAGAAAGGCCTGAGGGATCC<br>GTCTCCACTCTGAAGATCCAGCGCACACAGCAGGAGGACTCCGCCGTGTATCTCT<br>GTGCCAGCAGCCACCTCGCCGGGTTCACCGGGGAGCTGTTTTTTGGAGAAGGCTC<br>TAGGCTGACCGTACTGGAGGACCTGAAAAACGTGTTCCCACCCGAGGTCGCTGTG<br>TTTGAGCCATCAGAAGCAGAGATCTCCCACACCCAAAAGGCCACACTGGTGTGCC<br>TGGCCACAGGCTTCTACCCCGACCACGTGGAGCTGAGCTGGTGGGTGAATGGGAA<br>GGAGGTGCACAGTGGGGTCAGCACAGACCCGCAGCCCCTCAAGGAGCAGCCCGC<br>CCTCAATGACTCCAGATACTGCCTGAGCAGCCGCCTGAGGGTCTCGGCCACCTTCT<br>GGCAGAACCCCCGCAACCACTTCCGCTGTCAAGTCCAGTTCTACGGGCTCTCGGA<br>GAATGACGAGTGGACCCAGGATAGGGCCAAACCTGTCACCCAGATCGTCAGCGCC<br>GAGGCCTGGGGTAGAGCAGACTGTGGCTTCACCTCCGAGTCTTACCAGCAAGGGG<br>TCCTGTCTGCCACCATCCTCTATGAGATCTTGCTAGGGAAGGCCACCTTGTATGCC<br>GTGCTGGTCAGTGCCCTCGTGCTGATGGCCATGGTCAAGAGAAAGGATTCCAGAG<br>GC | TCR 3 - Beta<br>Native<br>Homo sapiens<br>(nt) |
| 25 | ATGGGCACCAGGCTCCTCTGCTGGGTGGTCCTGGGTTTCCTAGGGACAGATCACA<br>CAGGTGCTGGAGTCTCCCAGTCCCCTAGGTACAAAGTCGCAAAGAGAGGACAGGA<br>TGTAGCTCTCAGGTGTGATCCAATTTCGGGTCATGTATCCCTTTTTTGGTACCAAC<br>AGGCCCTGGGGCAGGGGCCAGAGTTTCTGACTTATTTCCAGAATGAAGCTCAACT<br>AGACAAATCGGGGCTGCCCAGTGATCGCTTCTTTTGCAGAAAGGCCTGAGGGATCC<br>GTCTCCACTCTGAAGATCCAGCGCACACAGCAGGAGGACTCCGCCGTGTATCTCT<br>GTGCCAGCAGCCACCTCGCCGGGTTCACCGGGGAGCTGTTTTTTGGAGAAGGCTC<br>TAGGCTGACCGTACTGGAGGACCTGAAAAACGTGTTCCCACCCGAGGTCGCTGTG<br>TTTGAGCCATCAGAAGCAGAGATCTCCCACACCCAAAAGGCCACACTGGTGTGCC<br>TGGCCACAGGCTTCTACCCCGACCACGTGGAGCTGAGCTGGTGGGTGAATGGGAA<br>GGAGGTGCACAGTGGGGTCTGTACAGACCCGCAGCCCCTCAAGGAGCAGCCCGCC<br>CTCAATGACTCCAGATACTGCCTGAGCAGCCGCCTGAGGGTCTCGGCCACCTTCTG<br>GCAGAACCCCCGCAACCACTTCCGCTGTCAAGTCCAGTTCTACGGGCTCTCGGAG<br>AATGACGAGTGGACCCAGGATAGGGCCAAACCTGTCACCCAGATCGTCAGCGCCG<br>AGGCCTGGGGTAGAGCAGACTGTGGCTTCACCTCCGAGTCTTACCAGCAAGGGGT<br>CCTGTCTGCCACCATCCTCTATGAGATCTTGCTAGGGAAGGCCACCTTGTATGCCG<br>TGCTGGTCAGTGCCCTCGTGCTGATGGCCATGGTCAAGAGAAAGGATTCCAGAGG<br>C | TCR 3 - Beta<br>Codon-optimized/<br>cysteine-modified<br>Homo sapiens<br>(nt) |
| 26 | GCGGCCGCCACCATGGGCACCAGGCTCCTCTGCTGGGTGGTCCTGGGTTTCCTAGG<br>GACAGATCACACAGGTGCTGGAGTCTCCCAGTCCCCTAGGTACAAAGTCGCAAAG<br>AGAGGACAGGATGTAGCTCTCAGGTGTGATCCAATTTCGGGTCATGTATCCCTTTT<br>TTGGTACCAACAGGCCCTGGGGCAGGGGCCAGAGTTTCTGACTTATTTCCAGAAT<br>GAAGCTCAACTAGACAAATCGGGGCTGCCCAGTGATCGCTTCTTTTGCAGAAAGGC<br>CTGAGGGATCCGTCTCCACTCTGAAGATCCAGCGCACACAGCAGGAGGACTCCGC<br>CGTGTATCTCTGTGCCAGCAGCCACCTCGCCGGGTTCACCGGGGAGCTGTTTTTTG<br>GAGAAGGCTCTAGGCTGACCGTACTGGAGGACCTGAAAAACGTGTTCCCACCCGA<br>GGTCGCTGTGTTTGAGCCATCAGAAGCAGAGATCTCCCACACCCAAAAGGCCACA<br>CTGGTGTGCCTGGCCACAGGCTTCTACCCCGACCACGTGGAGCTGAGCTGGTGGG<br>TGAATGGGAAGGAGGTGCACAGTGGGGTCTGTACAGACCCGCAGCCCCTCAAGG<br>AGCAGCCCGCCCTCAATGACTCCAGATACTGCCTGAGCAGCCGCCTGAGGGTCTC | TCR 3<br>Codon-optimized/<br>cysteine-modified<br>full sequence<br>Homo sapiens<br>(nt) |

| SEQ ID NO. | SEQUENCE | DESCRIPTION |
|---|---|---|
|  | GGCCACCTTCTGGCAGAACCCCCGCAACCACTTCCGCTGTCAAGTCCAGTTCTACG GGCTCTCGGAGAATGACGAGTGGACCCAGGATAGGGCCAAACCTGTCACCCAGAT CGTCAGCGCCGAGGCCTGGGGTAGAGCAGACTGTGGCTTCACCTCCGAGTCTTAC CAGCAAGGGGTCCTGTCTGCCACCATCCTCTATGAGATCTTGCTAGGGAAGGCCA CCTTGTATGCCGTGCTGGTCAGTGCCCTCGTGCTGATGGCCATGGTCAAGAGAAA GGATTCCAGAGGCGGATCCGGAGCTACCAACTTCTCTCTGCTGAAACAGGCAGGC GATGTGGAGGAAAATCCTGGGCCAATGTCACTTTCTAGCCTGCTGAAGGTGGTCA CAGCTTCACTGTGGCTAGGACCTGGCATTGCCCAGAAGATAACTCAAACCCAACC AGGAATGTTCGTGCAGGAAAAGGAGGCTGTGACTCTGGACTGCACATATGACACC AGTGATCAAAGTTATGGTCTCTTCTGGTACAAGCAGCCCAGCAGTGGGGAAATGA TTTTTCTTATTTATCAGGGGTCTTATGACGAGCAAAATGCAACAGAAGGTCGCTAC TCATTGAATTTCCAGAAGGCAAGAAAATCCGCCAACCTTGTCATCTCCGCTTCACA ACTGGGGGACTCAGCAATGTATTTCTGTGCAATGAGAGAGGGGCGAGGCTTCAAA ACTATCTTTGGAGCAGGAACAAGACTATTTGTTAAAGCAAATATCCAGAAGCCTG ACCCTGCCGTGTACCAGCTGAGAGACTCTAAATCCAGTGACAAGTCTGTCTGCCTA TTCACCGATTTTGATTCTCAAACAAATGTGTCACAAAGTAAGGATTCTGATGTGTA TATCACAGACAAATGTGTGCTAGACATGAGGTCTATGGACTTCAAGAGCAACAGT GCTGTGGCCTGGAGCAACAAATCTGACTTTGCATGTGCAAACGCCTTCAACAACA GCATTATTCCAGCAGACACCTTCTTCCCCAGCCCAGAAAGTTCCTGTGATGTCAAG CTGGTCGAGAAAAGCTTTGAAACAGATACGAACCTAAACTTTCAAAACCTGTCAG TGATTGGGTTCCGAATCCTCCTCCTGAAAGTGGCCGGGTTTAATCTGCTCATGACG CTGCGGCTGTGGTCTTCCTAAGGCGCGCC |  |
| 27 | MGTRLLCWVVLGFLGTDHTGAGVSQSPRYKVAKRGQDVALRCDPISGHVSLFWYQQ ALGQGPEFLTYFQNEAQLDKSGLPSDRFFAERPEGSVSTLKIQRTQQEDSAVYLCASS HLAGFTGELFFGEGSRLTVLEDLKNVFPPEVAVFEPSEAEISHTQKATLVCLATGFYPD HVELSWWVNGKEVHSGVCTDPQPLKEQPALNDSRYCLSSRLRVSATFWQNPRNHFR CQVQFYGLSENDEWTQDRAKPVTQIVSAEAWGRADCGFTSESYQQGVLSATILYEILL GKATLYAVLVSALVLMAMVKRKDSRGGSGATNFSLLKQAGDVEENPGPMSLSSLLK VVTASLWLGPGIAQKITQTQPGMFVQEKEAVTLDCTYDTSDQSYGLFWYKQPSSGEM IPLIYQGSYDEQNATEGRYSLNFQKARKSANLVISASQLGDSAMYFCAMREGRGFKTI FGAGTRLFVKANIQKPDPAVYQLRDSKSSDKSVCLFTDFDSQTNVSQSKDSDVYITDK CVLDMRSMDFKSNSAVAWSNKSDFACANAFNNSIIPADTFFPSPESSCDVKLVEKSFE TDTNLNFQNLSVIGFRILLLKVAGFNLLMTLRLWSS | TCR 3<br>Full sequence<br>Cysteine-<br>modified<br>*Homo sapiens*<br>(aa) |
| 28 | DAKTTQPNSMESNEEEPVHLPCNHSTISGTDYIHWYRQLPSQGPEYVIHGLTSNVNNR MASLAIAEDRKSSTLILHRATLRDAAVYYCILLVIRGTSYGKLTFGQGTILTVHPNIQNP DPAVYQLRDSKSSDKSVCLFTDFDSQTNVSQSKDSDVYITDKTVLDMRSMDFKSNSA VAWSNKSDFACANAFNNSIIPEDTFFPSPESSCDVKLVEKSFETDTNLNFQNLSVIGFRI LLLKVAGFNLLMTLRLWSS | TCR 4 - (E6)29<br>alpha<br>Native<br>*Homo sapiens*<br>(aa) |
| 29 | DAKTTQPNSMESNEEEPVHLPCNHSTISGTDYIHWYRQLPSQGPEYVIHGLTSNVNNR MASLAIAEDRKSSTLILHRATLRDAAVYYCILLVIRGTSYGKLTFGQGTILTVHPNIQNP DPAVYQLRDSKSSDKSVCLFTDFDSQTNVSQSKDSDVYITDKCVLDMRSMDFKSNSA VAWSNKSDFACANAFNNSIIPEDTFFPSPESSCDVKLVEKSFETDTNLNFQNLSVIGFRI LLLKVAGFNLLMTLRLWSS | TCR 4 - (E6)29<br>alpha<br>Cysteine-<br>modified<br>*Homo sapiens*<br>(aa) |
| 30 | ATGAAGTTGGTGACAAGCATTACTGTACTCCTATCTTTGGGTATTATGGGTGATGC TAAGACCACACAGCCAAATTCAATGGAGAGTAACGAAGAAGAGCCTGTTCACTTG CCTTGTAACCACTCCACAATCAGTGGAACTGATTACATACATTGGTATCGACAGCT TCCCTCCCAGGGTCCAGAGTACGTGATTCATGGTCTTACAAGCAATGTGAACAAC AGAATGGCCTCTCTGCAATCGCTGAAGACAGAAGTCCAGTACCTTGATCCTGC ACCGTGCTACCTTGAGAGATGCTGCTGTGTACTACTGCATCCTACTGGTAATCCGT GGTACTAGCTATGGAAAGCTGACATTTGGACAAGGGACCATCTTGACTGTCCATC CAAATATCCAGAACCCTGACCCTGCCGTGTACCAGCTGAGAGACTCTAAATCCAG TGACAAGTCTGTCTGCCTATTCACCGATTTTGATTCTCAAACAAATGTGTCACAAA GTAAGGATTCTGATGTGTATATCACAGACAAACTGTGCTAGACATGAGGTCTAT GGACTTCAAGAGCAACAGTGCTGTGGCCTGGAGCAACAAATCTGACTTTGCATGT GCAAACGCCTTCAACAACAGCATTATTCCAGAAGACACCTTCTTCCCCAGCCCAG AAAGTTCCTGTGATGTCAAGCTGGTCGAGAAAAGCTTTGAAACAGATACGAACCT AAACTTTCAAAACCTGTCAGTGATTGGGTTCCGAATCCTCCTCCTGAAAGTGGCCG GGTTTAATCTGCTCATGACGCTGCGGCTG | TCR 4 - (E6)29<br>alpha<br>Native<br>*Homo sapiens*<br>(nt) |
| 31 | ATGAAACTGGTGACCAGCATCACAGTCCTGCTGTCCCTGGGAATTATGGGCGACG CCAAGACCACACAGCCTAACTCTATGGAGAGTAATGAGGAAGAGCCTGTGCACCT GCCATGTAACCATTCAACTATCAGCGGCACCGATTACATTCACTGGTATCGGCAGC TGCCCTCCCAGGGACCTGAATACGTGATCCATGGCCTGACCTCAAATGTCAACAA TCGCATGGCTAGCCTGGCTATCGCAGAGGACCGAAAGTCAAGCACCCTGATTCTG CACCGAGCCACACTGCGAGATGCAGCCGTGTACTATTGCATCCTGCTGGTCATTAG AGGGACCAGCTACGGAAAACTGACATTTGGCCAGGGGACTATCCTGACCGTGCAT CCTAACATTCAGAATCCCGACCCTGCCGTGTATCAGCTGAGGGACTCTAAGTCCTC TGATAAAAGCGTGTGCCTGTTCACTGACTTTGATTCCCAGACCAACGTGTCCCAGT | TCR 4 - (E6)29<br>alpha<br>Codon-optimized/<br>cysteine-modified<br>*Homo sapiens*<br>(nt) |

| SEQ ID NO. | SEQUENCE | DESCRIPTION |
|---|---|---|
| | CTAAGGACTCTGACGTGTACATCACAGACAAATGCGTCCTGGATATGCGCAGCAT<br>GGACTTCAAGAGTAACTCAGCCGTGGCTTGGTCCAACAAGTCTGATTTCGCATGC<br>GCCAACGCTTTTAACAACAGTATCATCCCAGAAGATACCTTCTTTCCATCACCCGA<br>GAGTTCATGTGACGTGAAGCTGGTCGAAAAATCTTTCGAGACTGATACCAACCTG<br>AATTTTCAGAACCTGAGTGTGATCGGGTTCAGGATTCTGCTGCTGAAGGTCGCCGG<br>ATTCAATCTGCTGATGACACTGCGCCTGTGGAGCTCC | |
| 32 | DTGVSQDPRHKITKRGQNVTFRCDPISEHNRLYWYRQTLGQGPEFLTYFQNEAQLEKS<br>RLLSDRFSAERPKGSFSTLEIQRTEQGDSAMYLCASSPGGGNTEAFFGQGTRLTVVED<br>LNKVFPPEVAVFEPSEAEISHTQKATLVCLATGFFPDHVELSWWVNGKEVHSGVSTDP<br>QPLKEQPALNDSRYCLSSRLRVSATFWQNPRNHFRCQVQFYGLSENDEWTQDRAKPV<br>TQIVSAEAWGRADCGFTSVSYQQGVLSATILYEILLGKATLYAVLVSALVLMAMVKR<br>KDF | TCR 4 - (E6)29<br>Beta<br>Native<br>Homo sapiens<br>(aa) |
| 33 | DTGVSQDPRHKITKRGQNVTFRCDPISEHNRLYWYRQTLGQGPEFLTYFQNEAQLEKS<br>RLLSDRFSAERPKGSFSTLEIQRTEQGDSAMYLCASSPGGGNTEAFFGQGTRLTVVED<br>LNKVFPPEVAVFEPSEAEISHTQKATLVCLATGFFPDHVELSWWVNGKEVHSGVCTD<br>PQPLKEQPALNDSRYCLSSRLRVSATFWQNPRNHFRCQVQFYGLSENDEWTQDRAKP<br>VTQIVSAEAWGRADCGFTSVSYQQGVLSATILYEILLGKATLYAVLVSALVLMAMVK<br>RKDF | TCR 4 - (E6)29<br>Beta<br>Cysteine-<br>modified<br>Homo sapiens<br>(aa) |
| 34 | ATGGGCACCAGCCTCCTCTGCTGGATGGCCCTGTGTCTCCTGGGGGCAGATCACGC<br>AGATACTGGAGTCTCCCAGGACCCCAGACACAAGATCACAAAGAGGGGACAGAA<br>TGTAACTTTCAGGTGTGATCCAATTTCTGAACACAACCGCTTTTATTGGTACCGAC<br>AGACCCTGGGGCAGGGCCCAGAGTTTCTGACTTACTTCCAGAATGAAGCTCAACT<br>AGAAAAATCAAGGCTGCTCAGTGATCGGTTCTCTGCAGAGAGGCCTAAGGGATCT<br>TTCTCCACCTTGGAGATCCAGCGCACAGAGCAGGGGGACTCGGCCATGTATCTCT<br>GTGCCAGCAGCCCCGGCGGGGGGAACACTGAAGCTTTCTTTGGACAAGGCACCAG<br>ACTCACAGTTGTAGAGGACCTGAACAAGGTGTTCCCACCCGAGGTCGCTGTGTTT<br>GAGCCATCAGAAGCAGAGATCTCCCACACCCAAAAGGCCACACTGGTGTGCCTGG<br>CCACAGGCTTCTTCCCTGACCACGTGGAGCTGAGCTGGTGGGTGAATGGGAAGGA<br>GGTGCACAGTGGGGTCAGCACGGACCCGCAGCCCCTCAAGGAGCAGCCCGCCCTC<br>AATGACTCCAGATACTGCCTGAGCAGCCGCCTGAGGGTCTCGGCCACCTTCTGGC<br>AGAACCCCCGCAACCACTTCCGCTGTCAAGTCCAGTTCTACGGGCTCTCGGAGAA<br>TGACGAGTGGACCCAGGATAGGGCAAAACCCGTCACCCAGATCGTCAGCGCCGAG<br>GCCTGGGGTAGAGCAGACTGTGGCTTTACCTCGGTGTCCTACCAGCAAGGGGTCC<br>TGTCTGCCACCATCCTCTATGAGATCCTGCTAGGGAAGGCCACCCTGTATGCTGTG<br>CTGGTCAGCGCCCTTGTGTTGATGGCCATGGTCAAGAGAAAGGATTTC | TCR 4 - (E6)29<br>Beta<br>Native<br>Homo sapiens<br>(nt) |
| 35 | ATGGGGACTAGCCTGCTGTGCTGGATGGCACTGTGCCTGCTGGGAGCAGACCACG<br>CAGATACCGGAGTGAGCCAGGACCCAAGACATAAGATCACAAAAAGGGGCCAGA<br>ACGTGACTTTTAGATGCGATCCCATTAGCGAACACAATAGACTGTACTGGTATAG<br>GCAGACACTGGGACAGGGACCCAGAGTTCCTGACTTACTTTCAGAACGAAGCTCAG<br>CTGGAGAAGAGTCGCCTGCTGTCAGACCGGTTCAGCGCCGAGCGACCAAAAGGCT<br>CTTTCAGTACACTGGAAATCCAGCGAACTGAGCAGGGGGATTCCGCCATGTATCT<br>GTGCGCTAGCTCCCCAGGAGGAGGAAACACCGAAGCCTTCTTTGGACAGGGCACA<br>CGGCTGACTGTGGTCGAGGACCTGAATAAGGTGTTCCCCCCTGAAGTGGCCGTCTT<br>TGAGCCTTCCGAAGCTGAGATTTCTCACACCCAGAAAGCCACCCTGGTGTGCCTG<br>GCAACAGGCTTCTTTCCAGATCACGTGGAACTGAGCTGGTGGGTCAACGGAAAGG<br>AGGTGCATAGCGGCGTCTGCACTGACCCACAGCCCCTGAAAGAGCAGCCCGCACT<br>GAATGATAGCAGGTACTGCCTGTCTAGTCGGCTGAGAGTGTCCGCCACCTTTTGGC<br>AGAACCCTAGGAATCATTTCCGCTGTCAGGTGCAGTTTTATGGCCTGTCCGAAAAC<br>GACGAGTGGACTCAGGATCGGGCCAAGCCCGTGACCCAGATCGTCTCTGCAGAAG<br>CCTGGGGCAGAGCTGACTGCGGGTTCACCTCAGTGAGCTACCAGCAGGGAGTCCT<br>GTCCGCTACCATCCTGTACGAGATTCTGCTGGGCAAGGCTACACTGTATGCAGTGC<br>TGGTCTCTGCACTGGTGCTGATGGCCATGGTCAAGCGCAAAGACTTC | TCR 4 - (E6)29<br>Beta<br>Codon-optimized/<br>cysteine-modified<br>Homo sapiens<br>(nt) |
| 36 | GCGGCCGCCACCATGGGGACTAGCCTGCTGTGCTGGATGGCACTGTGCCTGCTGG<br>GAGCAGACCACGCAGATACCGGAGTGAGCCAGGACCCAAGACATAAGATCACAA<br>AAAGGGGCCAGAACGTGACTTTTAGATGCGATCCCATTAGCGAACACAATAGACT<br>GTACTGGTATAGGCAGACACTGGGACAGGGACCAGAGTTCCTGACTTACTTTCAG<br>AACGAAGCTCAGCTGGAGAAGAGTCGCCTGCTGTCAGACCGGTTCAGCGCCGAG<br>GACCAAAAGGCTCTTTCAGTACACTGGAAATCCAGCGAACTGAGCAGGGGGATTC<br>CGCCATGTATCTGTGCGCTAGCTCCCCAGGAGGAGGAAACACCGAAGCCTTCTTT<br>GGACAGGGCACACGGCTGACTGTGGTCGAGGACCTGAATAAGGTGTTCCCCCCTG<br>AAGTGGCCGTCTTTGAGCCTTCCGAAGCTGAGATTTCTCACACCCAGAAAGCCAC<br>CCTGGTGTGCCTGGCAACAGGCTTCTTTCCAGATCACGTGGAACTGAGCTGGTGG<br>GTCAACGGAAAGGAGGTGCATAGCGGCGTCTGCACTGACCCACAGCCCCTGAAAG<br>AGCAGCCCGCACTGAATGATAGCAGGTACTGCCTGTCTAGTCGGCTGAGAGTGTC<br>CGCCACCTTTTGGCAGAACCCTAGGAATCATTTCCGCTGTCAGGTGCAGTTTTATG<br>GCCTGTCCGAAAACGACGAGTGGACTCAGGATCGGGCCAAGCCCGTGACCCAGAT<br>CGTCTCTGCAGAAGCCTGGGGCAGAGCTGACTGCGGGTTCACCTCAGTGAGCTAC<br>CAGCAGGGAGTCCTGTCCGCTACCATCCTGTACGAGATTCTGCTGGGCAAGGCTA | TCR 4 - (E6)29<br>Codon-optimized/<br>cysteine-modified<br>full sequence<br>Homo sapiens<br>(nt) |

| SEQ ID NO. | SEQUENCE | DESCRIPTION |
|---|---|---|
| | CACTGTATGCAGTGCTGGTCTCTGCACTGGTGCTGATGGCCATGGTCAAGCGCAA AGACTTCGGGAGTGGAGCAACAAACTTTTCACTGCTGAAGCAGGCCGGCGATGTG GAGGAAAATCCTGGGCCAATGAAACTGGTGACCAGCATCACAGTCCTGCTGTCCC TGGGAATTATGGGCGACGCCAAGACCACACAGCCTAACTCTATGGAGAGTAATGA GGAAGAGCCTGTGCACCTGCCATGTAACCATTCAACTATCAGCGGCACCGATTAC ATTCACTGGTATCGGCAGCTGCCCTCCCAGGGACCTGAATACGTGATCCATGGCCT GACCTCAAATGTCAACAATCGCATGGCTAGCCTGGCTATCGCAGAGGACCGAAAG TCAAGCACCCTGATTCTGCACCGAGCCACACTGCGAGATGCAGCCGTGTACTATT GCATCCTGCTGGTCATTAGAGGGACCAGCTACGGAAAACTGACATTTGGCCAGGG GACTATCCTGACCGTGCATCCTAACATTCAGAATCCCGACCCTGCCGTGTATCAGC TGAGGGACTCTAAGTCCTCTGATAAAAGCGTGTGCCTGTTCACTGACTTTGATTCC CAGACCAACGTGTCCCAGTCTAAGGACTCTGACGTGTACATCACAGACAAATGCG TCCTGGATATGCGCAGCATGGACTTCAAGAGTAACTCAGCCGTGGCTTGGTCCAA CAAGTCTGATTTCGCATGCGCCAACGCTTTTAACAACAGTATCATCCCAGAAGATA CCTTCTTTCCATCACCCGAGAGTTCATGTGACGTGAAGCTGGTCGAAAAATCTTTC GAGACTGATACCAACCTGAATTTTCAGAACCTGAGTGTGATCGGGTTCAGGATTCT GCTGCTGAAGGTCGCCGGATTCAATCTGCTGATGACACTGCGCCTGTGGAGCTCCT GAGGCGCGCC | |
| 37 | MGTSLLCWMALCLLGADHADTGVSQDPRHKITKRGQNVTFRCDPISEHNRLYWYRQ TLGQGPEFLTYFQNEAQLEKSRLLSDRFSAERPKGSFSTLEIQRTEQGDSAMYLCASSP GGGNTEAFFGQGTRLTVVEDLNKVFPPEVAVFEPSEAEISHTQKATLVCLATGFFPDH VELSWWVNGKEVHSGVCTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDFGSGATNFSLLKQAGDVEENPGPMKLVTSITVL LSLGIMGDAKTTQPNSMESNEEEPVHLPCNHSTISGTDYIHWYRQLPSQGPEYVIHGLT SNVNNRMASLAIAEDRKSSTLILHRATLRDAAVYYCILLVIRGTSYGKLTFGQGTILTV HPNIQNPDPAVYQLRDSKSSDKSVCLFTDFDSQTNVSQSKDSDVYITDKCVLDMRSM DFKSNSAVAWSNKSDFACANAFNNSIIPEDTFFPSPESSCDVKLVEKSFETDTNLNFQN LSVIGFRILLLKVAGFNLLMTLRLWSS | TCR 4 - (E6)29 Full sequence Cysteine-modified Homo sapiens (aa) |
| 38 | AQKITQTQPGMFVQEKEAVTLDCTYDTSDQSYGLFWYKQPSSGEMIFLIYQGSYDEQ NATEGRYSLNFQKARKSANLVISASQLGDSAMYFCAMREGTGTSYGKLTFGQGTILT VHPNIQNPDPAVYQLRDSKSSDKSVCLFTDFDSQTNVSQSKDSDVYITDKTVLDMRS MDFKSNSAVAWSNKSDFACANAFNNSIIPEDTFFPSPESSCDVKLVEKSFETDTNLNFQ NLSVIGFRILLLKVAGFNLLMTLRLWSS | TCR 5 - (E6)29 - TCR alpha Native Homo sapiens (aa) |
| 39 | AQKITQTQPGMFVQEKEAVTLDCTYDTSDQSYGLFWYKQPSSGEMIFLIYQGSYDEQ NATEGRYSLNFQKARKSANLVISASQLGDSAMYFCAMREGTGTSYGKLTFGQGTILT VHPNIQNPDPAVYQLRDSKSSDKSVCLFTDFDSQTNVSQSKDSDVYITDKCVLDMRS MDFKSNSAVAWSNKSDFACANAFNNSIIPEDTFFPSPESSCDVKLVEKSFETDTNLNFQ NLSVIGFRILLLKVAGFNLLMTLRLWSS | TCR 5 - (E6)29 - TCR alpha Cysteine-modified Homo sapiens (aa) |
| 40 | ATGTCACTTTCTAGCCTGCTGAAGGTGGTCACAGCTTCACTGTGGCTAGGACCTGG CATTGCCCAGAAGATAACTCAAACCCAACCAGGAATGTTCGTGCAGGAAAAGGA GGCTGTGACTCTGGACTGCACATATGACACCAGTGATCAAAGTTATGGTCTATTCT GGTACAAGCAGCCCAGCAGTGGGGAAATGATTTTTCTTATTTATCAGGGGTCTTAT GACGAGCAAATGCAACGAAAGGTCGCTACTCATTGAATTTCCAGAAGGCAAGA AAATCCGCCAACCTTGTCATCTCCGCTTCACAACTGGGGGACTCAGCAATGTATTT CTGTGCAATGAGAGAGGGCACAGGTACTAGCTATGGAAAGCTGACATTTGGACAA GGGACCATCTTGACTGTCCATCCAAATATCCAGAACCCTGACCCTGCCGTGTACCA GCTGAGAGACTCTAAATCCAGTGACAAGTCTGTCTGCCTATTCACCGATTTTGATT CTCAAACAAATGTGTCACAAAGTAAGGATTCTGATGTGTATATCACAGACAAAAC TGTGCTAGACATGAGGTCTATGGACTTCAAGAGCAACAGTGCTGTGGCCTGGAGC AACAAATCTGACTTTGCATGTGCAAACGCCTTCAACAACAGCATTATTCCAGAAG ACACCTTCTTCCCCAGCCCAGAAAGTTCCTGTGATGTCAAGCTGGTCGAGAAAGA CTTTGAAACAGATACGAACCTAAACTTTCAAAACCTGTCAGTGATTGGGTTCCGA ATCCTCCTCCTGAAAGTGGCCGGGTTTAATCTGCTCATGACGCTGCGGCTG | TCR 5 - (E6)29 - TCR alpha Native Homo sapiens (nt) |
| 41 | ATGAGTCTGTCCTCTCTGCTGAAGGTGGTCACTGCATCACTGTGGCTGGGACCAGG AATCGCACAGAAAATTACCCAGACACAGCCTGGCATGTTTGTCCAGGAGAAGGAA GCCGTGACCCTGGACTGTACTTACGACACCAGCGATCAGTCCTACGGGCTGTTTTG GTATAAGCAGCCAAGTTCAGGAGAGATGATCTTCCTGATCTACCAGGGCAGCTAT GACGAGCAGAACGCTACAGAAGGCAGGTATAGCCTGAATTTCCAGAAAGCCCGC AAGTCCGCTAACCTGGTCATCTCTGCCAGTCAGCTGGGGGATTCTGCCATGTACTT TTGCGCTATGAGGGAGGGAACTGGCACCAGCTATGGAAAGCTGACCTTCGGGCAG GGAACAATCCTGACTGTCCATCCCAACATTCAGAATCCAGACCCTGCCGTGTACC AGCTGCGAGACAGTAAAAGCTCCGATAAGAGCGTGTGCCTGTTCACAGACTTTGA TTCTCAGACTAACGTGAGCCAGAGCAAGACAGTGATGTCTATATTACCGACAAG TGCGTGCTGGATATGCGCAGCATGGACTTTAAATCCAACTCTGCAGTGGCCTGGTC TAATAAGAGTGATTTCGCTTGCGCAAACGCCTTTAACAATTCAATCATTCCCGAGG ATACCTTCTTTCCAAGCCCCGAATCTAGTTGTGACGTGAAACTGGTGGAGAAGTCT | TCR 5 - (E6)29 - TCR alpha Codon-optimized/ cysteine-modified Homo sapiens (nt) |

| SEQ ID NO. | SEQUENCE | DESCRIPTION |
|---|---|---|
| | TTCGAAACAGATACTAACCTGAATTTTCAGAATCTGAGTGTCATCGGGTTCCGGAT<br>TCTGCTGCTGAAGGTGGCCGGATTCAACCTGCTGATGACCCTGAGACTGTGGTCA<br>AGC | |
| 42 | DVKVTQSSRYLVKRTGEKVFLECVQDMDHENMFWYRQDPGLGLRLIYFSYDVKMK<br>EKGDIPEGYSVSREKKERFSLILESASTNQTSMYLCASSPWGETHQPQHFGDGTRLSIL<br>EDLNKVFPPEVAVFEPSEAEISHTQKATLVCLATGFFPDHVELSWWVNGKEVHSGVST<br>DPQPLKEQPALNDSRYCLSSRLRVSATFWQNPRNHFRCQVQFYGLSENDEWTQDRAK<br>PVTQIVSAEAWGRADCGFTSVSYQQGVLSATILYEILLGKATLYAVLVSALVLMAMV<br>KRKDF | TCR 5 - (E6)29 -<br>TCR beta<br>Native<br>Homo sapiens<br>(aa) |
| 43 | DVKVTQSSRYLVKRTGEKVFLECVQDMDHENMFWYRQDPGLGLRLIYFSYDVKMK<br>EKGDIPEGYSVSREKKERFSLILESASTNQTSMYLCASSPWGETHQPQHFGDGTRLSIL<br>EDLNKVFPPEVAVFEPSEAEISHTQKATLVCLATGFFPDHVELSWWVNGKEVHSGVC<br>TDPQPLKEQPALNDSRYCLSSRLRVSATFWQNPRNHFRCQVQFYGLSENDEWTQDRA<br>KPVTQIVSAEAWGRADCGFTSVSYQQGVLSATILYEILLGKATLYAVLVSALVLMAM<br>VKRKDF | TCR 5 - (E6)29 -<br>TCR beta<br>Cysteine-<br>modified<br>Homo sapiens<br>(aa) |
| 44 | ATGGGAATCAGGCTCCTCTGTCGTGTGGCCTTTTGTTTCCTGGCTGTAGGCCTCGT<br>AGATGTGAAAGTAACCCAGAGCTCGAGATATCTAGTCAAAAGGACGGGAGAGAA<br>AGTTTTTCTGGAATGTGTCCAGGATATGGACCATGAAAATATGTTCTGGTATCGAC<br>AAGACCCAGGTCTGGGGCTACGGCTGATCTATTTCTCATATGATGTTAAAATGAA<br>AGAAAAGGAGATATTCCTGAGGGGTACAGTGTCTCTAGAGAGAAGAAGGAGCG<br>CTTCTCCCTGATTCTGGAGTCCGCCAGCACCAACCAGACATCTATGTACCTCTGTG<br>CCAGCAGCCCATGGGGAGAAACTCATCAGCCCCAGCATTTTGGTGATGGGACTCG<br>ACTCTCCATCCTAGAGGACCTGAACAAGGTGTTCCCACCCGAGGTCGCTGTGTTTG<br>AGCCATCAGAAGCAGAGATCTCCCACACCCAAAAGGCCACACTGGTGTGCCTGGC<br>CACAGGCTTCTTCCCTGACCACGTGGAGCTGAGCTGGTGGGTGAATGGGAAGGAG<br>GTGCACAGTGGGGTCAGCACGGACCCGCAGCCCCTCAAGGAGCAGCCCGCCCTCA<br>ATGACTCCAGATACTGCCTGAGCAGCCGCCTGAGGGTCTCGGCCACCTTCTGGCA<br>GAACCCCCGCAACCACTTCCGCTGTCAAGTCCAGTTCTACGGGCTCTCGGAGAAT<br>GACGAGTGGACCCAGGATAGGGCCAAACCCGTCACCCAGATCGTCAGCGCCGAG<br>GCCTGGGGTAGAGCAGACTGTGGCTTTACCTCGGTGTCCTACCAGCAAGGGGTCC<br>TGTCTGCCACCATCCTCTATGAGATCCTGCTAGGGAAGGCCACCCTGTATGCTGTG<br>CTGGTCAGCGCCCTTGTGTTGATGGCCATGGTCAAGAGAAAGGATTTC | TCR 5 - (E6)29 -<br>TCR beta<br>Native<br>Homo sapiens<br>(nt) |
| 45 | ATGGGAATCAGGCTGCTGTGCCGCGTCGCATTCTGTTTTCTGGCCGTGGGCCTGGT<br>GGACGTGAAAGTGACTCAGAGCTCCAGATACCTGGTGAAAAGGACCGGCGAGAA<br>GGTCTTTCTGGAATGCGTGCAGGACATGGATCACGAGAATATGTTCTGGTATCGG<br>CAGGATCCAGGCCTGGGGCTGAGACTGATCTACTTTTCCTATGATGTGAAGATGA<br>AAGAGAAGGGCGACATTCCCGAAGGGTACTCCGTGTCTCGCGAGAAGAAGGAA<br>GATTCAGCCTGATCCTGGAGAGTGCTTCAACCAATCAGACATCCATGTATCTGTGC<br>GCATCTAGTCCTTGGGGCGAGACACACCAGCCACAGCATTTCGGAGATGGCACTC<br>GGCTGAGCATCCTGGAAGACCTGAACAAAGTGTTCCCCCCTGAGGTCGCCGTGTT<br>CGAACCTTCAGAGGCAGAAATTAGCCACACTCAGAAGGCCACCCTGGTGTGCCTG<br>GCCACTGGCTTCTTTCCAGACCACGTCGAGCTGTCCTGGTGGGTGAATGGGAAAA<br>AGTCCATAGTGGAGTGTGCACCGACCCACAGCCCTGAAGGAGCAGCCCGCACT<br>GAACGATTCCAGATACTGCCTGTCAAGCCGGCTGAGAGTGTCTGCCACTTTTTGGC<br>AGAACCCTCGAAATCATTTCCGGTGTCAGGTGCAGTTTTATGGCCTGAGCGAGAA<br>CGACGAATGGACCCAGGATCGAGCCAAACCTGTCACACAGATCGTGTCCGCCGAG<br>GCTTGGGGACGCGCTGATTGCGCTTCACAAGCGTCTCCTACCAGCAGGGCGTGC<br>TGTCTGCCACCATCCTGTACGAAATTCTGCTGGGGAAGGCTACACTGTATGCCGTG<br>CTGGTGAGCGCCCTGGTGCTGATGGCAATGGTGAAAAGGAAGGACTTC | TCR 5 - (E6)29 -<br>TCR beta<br>Codon-optimized/<br>cysteine-modified<br>Homo sapiens<br>(nt) |
| 46 | GCGGCCGCCACCATGGGAATCAGGCTGCTGTGCCGCGTCGCATTCTGTTTTCTGGC<br>CGTGGGCCTGGTGGACGTGAAAGTGACTCAGAGCTCCAGATACCTGGTGAAAAGG<br>ACCGGCGAGAAGGTCTTTCTGGAATGCGTGCAGGACATGGATCACGAGAATATGT<br>TCTGGTATCGGCAGGATCCAGGCCTGGGGCTGAGACTGATCTACTTTTCCTATGAT<br>GTGAAGATGAAAGAGAAGGGCGACATTCCCGAAGGGTACTCCGTGTCTCGCGAG<br>AAGAAGAACGATTCAGCCTGATCCTGGAGAGTGCTTCAACCAATCAGACATCCA<br>TGTATCTGTGCGCATCTAGTCCTTGGGGCGAGACACACCAGCCACAGCATTTCGG<br>AGATGGCACTCGGCTGAGCATCCTGGAAGACCTGAACAAAGTGTTCCCCCCTGAG<br>GTCGCCGTGTTCGAACCTTCAGAGGCAGAAATTAGCCACACTCAGAAGGCCACCC<br>TGGTGTGCCTGGCCACTGGCTTCTTTCCAGACCACGTCGAGCTGTCCTGGTGGGTG<br>AATGGGAAGAAGTCCATAGTGGAGTGTGCACCGACCCACAGCCCTGAAGGAG<br>CAGCCCGCACTGAACGATTCCAGATACTGCCTGTCAAGCCGGCTGAGAGTGTCTG<br>CCACTTTTTGGCAGAACCCTCGAAATCATTTCCGGTGTCAGGTGCAGTTTTATGGC<br>CTGAGCGAGAACGACGAATGGACCCAGGATCGAGCCAAACCTGTCACACAGATC<br>GTGTCCGCCGAGGCTTGGGGACGCGCTGATTGCGGCTTCACAAGCGTCTCCTACC<br>AGCAGGGCGTGCTGTCTGCCACCATCCTGTACGAAATTCTGCTGGGGAAGGCTAC<br>ACTGTATGCCGTGCTGGTGAGCGCCCTGGTGCTGATGGCAATGGTGAAAAGGAAG<br>GACTTCGGTCCGGAGCCACAAATTTTTCTCTGCTGAAACAGGCTGGCGATGTGG<br>AGGAAAACCCTGGGCCAATGAGTCTGTCCTCTCTGCTGAAGGTGGTCACTGCATC | TCR 5 - (E6)29 -<br>TCR<br>Codon-optimized/<br>cysteine-modified<br>full sequence<br>Homo sapiens<br>(nt) |

SEQUENCE TABLE

| SEQ ID NO. | SEQUENCE | DESCRIPTION |
|---|---|---|
| | ACTGTGGCTGGGACCAGGAATCGCACAGAAAATTACCCAGACACAGCCTGGCATG TTTGTCCAGGAGAAGGAAGCCGTGACCCTGGACTGTACTTACGACACCAGCGATC AGTCCTACGGGCTGTTTTGGTATAAGCAGCCAAGTTCAGGAGAGATGATCTTCCTG ATCTACCAGGGCAGCTATGACGAGCAGAACGCTACAGAAGGCAGGTATAGCCTG AATTTCCAGAAAGCCCGCAAGTCCGCTAACCTGGTCATCTCTGCCAGTCAGCTGG GGGATTCTGCCATGTACTTTTGCGCTATGAGGGAGGGAACTGGCACCAGCTATGG AAAGCTGACCTTCGGGCAGGGAACAATCCTGACTGTCCATCCCAACATTCAGAAT CCAGACCCTGCCGTGTACCAGCTGCGAGACAGTAAAAGCTCCGATAAGAGCGTGT GCCTGTTCACAGACTTTGATTCTCAGACTAACGTGAGCCAGAGCAAAGACAGTGA TGTCTATATTACCGACAAGTGCGTGCTGGATATGCGCAGCATGGACTTTAAATCCA ACTCTGCAGTGGCCTGGTCTAATAAGAGTGATTTCGCTTGCGCAAACGCCTTTAAC AATTCAATCATTCCCGAGGATACCTTCTTTCCAAGCCCCGAATCTAGTTGTGACGT GAAACTGGTGGAGAAGTCTTTCGAAACAGATACTAACCTGAATTTTCAGAATCTG AGTGTCATCGGGTTCCGGATTCTGCTGCTGAAGGTGGCCGGATTCAACCTGCTGAT GACCCTGAGACTGTGGTCAAGCTGAGGCGCGCC | |
| 47 | MGIRLLCRVAFCFLAVGLVDVKVTQSSRYLVKRTGEKVPLECVQDMDHENMFWYR QDPGLGLRLIYFSYDVKMKEKGDIPEGYSVSREKKERFSLILESASTNQTSMYLCASSP WGETHQPQHFGDGTRLSILEDLNKVFPPEVAVFEPSEAEISHTQKATLVCLATGFFPDH VELSWWVNGKEVHSGVCTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDFGSGATNFSLLKQAGDVEENPGPMSLSSLLKVV TASLWLGPGIAQKITQTQPGMFVQEKEAVTLDCTYDTSDQSYGLFWYKQPSSGEMIFL IYQGSYDEQNATEGRYSLNFQKARKSANLVISASQLGDSAMYFCAMREGTGTSYGKL TFGQGTILTVHPNIQNPDPAVYQLRDSKSSDKSVCLFTDFDSQTNVSQSKDSDVYITDK CVLDMRSMDFKSNSAVAWSNKSDFACANAFNNSIIPEDTFFPSPESSCDVKLVEKSFE TDTNLNFQNLSVIGFRILLLKVAGFNLLMTLRLWSS | TCR 5 - (E6)29 - TCR Full sequence Cysteine-modified *Homo sapiens* (aa) |
| 48 | GEDVEQSLFLSVREGDSSVINCTYTDSSSTYLYWYKQEPGAGLQLLTYIFSNMDMKQ DQRLTVLLNKKDKHLSLRIADTQTGDSAIYFCAESIRGFGNVLHCGSGTQVIVLPHIQN PDPAVYQLRDSKSSDKSVCLFTDFDSQTNVSQSKDSDVYITDKTVLDMRSMDFKSNS AVAWSNKSDFACANAFNNSIIPEDTFFPSPESSCDVKLVEKSFETDTNLNFQNLSVIGF RILLLKVAGFNLLMTLRLWSS | TCR 6 - Alpha Native *Homo sapiens* (aa) |
| 49 | GEDVEQSLFLSVREGDSSVINCTYTDSSSTYLYWYKQEPGAGLQLLTYIFSNMDMKQ DQRLTVLLNKKDKHLSLRIADTQTGDSAIYFCAESIRGFGNVLHCGSGTQVIVLPHIQN PDPAVYQLRDSKSSDKSVCLFTDFDSQTNVSQSKDSDVYITDKCVLDMRSMDFKSNS AVAWSNKSDFACANAFNNSIIPEDTFFPSPESSCDVKLVEKSFETDTNLNFQNLSVIGF RILLLKVAGFNLLMTLRLWSS | TCR 6 - Alpha Cysteine-modified *Homo sapiens* (aa) |
| 50 | ATGAAGACATTTGCTGGATTTTCGTTCCTGTTTTTGTGGCTGCAGCTGGACTGTAT GAGTAGAGGAGAGGATGTGGAGCAGAGTCTTTTCCTGAGTGTCCGAGAGGGAGA CAGCTCCGTTATAAACTGCACTTACACAGACAGCTCCTCCACCTACTTATACTGGT ATAAGCAAGAACCTGGAGCAGGTCTCCAGTTGCTGACGTATATTTTTTCAAATATG GACATGAAACAAGACCAAAGACTCACTGTTCTATTGAATAAAAAGGATAAACATC TGTCTCTGCGCATTGCAGACACCCAGACTGGGGACTCAGCTATCTACTTCTGTGCA GAGAGTATAAGAGGCTTTGGGAATGTGCTGCATTGCGGGTCCGGCACTCAAGTGA TTGTTTTACCACATATCCAGAACCCTGACCCTGCCGTGTACCAGCTGAGAGACTCT AAATCCAGTGACAAGTCTGTCTGCCTATTCACCGATTTTGATTCTCAAACAAATGT GTCACAAAGTAAGGATTCTGATGTGTATATCACAGACAAAACTGTGCTAGACATG AGGTCTATGGACTTCAAGAGCAACAGTGCTGTGGCCTGGAGCAACAAATCTGACT TTGCATGTGCAAACGCCTTCAACAACAGCATTATTCCAGAAGACACCTTCTTCCCC AGCCCAGAAAGTTCCTGTGATGTCAAGCTGGTCGAGAAAAGCTTTGAAACAGATA CGAACCTAAACTTTCAAAACCTGTCAGTGATTGGGTTCCGAATCCTCCTCCTGAAA GTGGCCGGGTTTAATCTGCTCATGACGCTGCGGCTG | TCR 6 - Alpha Native *Homo sapiens* (nt) |
| 51 | ATGAAGACATTTGCTGGATTTTCGTTCCTGTTTTTGTGGCTGCAGCTGGACTGTAT GAGTAGAGGAGAGGATGTGGAGCAGAGTCTTTTCCTGAGTGTCCGAGAGGGAGA CAGCTCCGTTATAAACTGCACTTACACAGACAGCTCCTCCACCTACTTATACTGGT ATAAGCAAGAACCTGGAGCAGGTCTCCAGTTGCTGACGTATATTTTTTCAAATATG GACATGAAACAAGACCAAAGACTCACTGTTCTATTGAATAAAAAGGATAAACATC TGTCTCTGCGCATTGCAGACACCCAGACTGGGGACTCAGCTATCTACTTCTGTGCA GAGAGTATAAGAGGCTTTGGGAATGTGCTGCATTGCGGGTCCGGCACTCAAGTGA TTGTTTTACCACATATCCAGAACCCTGACCCTGCCGTGTACCAGCTGAGAGACTCT AAATCCAGTGACAAGTCTGTCTGCCTATTCACCGATTTTGATTCTCAAACAAATGT GTCACAAAGTAAGGATTCTGATGTGTATATCACAGACAAAACTGTGCTAGACATG AGGTCTATGGACTTCAAGAGCAACAGTGCTGTGGCCTGGAGCAACAAATCTGACT TTGCATGTGCAAACGCCTTCAACAACAGCATTATTCCAGAAGACACCTTCTTCCCC AGCCCAGAAAGTTCCTGTGATGTCAAGCTGGTCGAGAAAAGCTTTGAAACAGATA CGAACCTAAACTTTCAAAACCTGTCAGTGATTGGGTTCCGAATCCTCCTCCTGAAA GTGGCCGGGTTTAATCTGCTCATGACGCTGCGGCTGTGGTCTTCC | TCR 6 - Alpha Codon-optimized/ cysteine-modified *Homo sapiens* (nt) |

| SEQ ID NO. | SEQUENCE | DESCRIPTION |
|---|---|---|
| 52 | EPEVTQTPSHQVTQMGQEVILRCVPISNHLYFYWYRQILGQKVEFLVSFYNNEISEKSE IFDDQFSVERPDGSNFTLKIRSTKLEDSAMYFCASTTRSSYEQYFGPGTRLTVTEDLKN VFPPEVAVFEPSEAEISHTQKATLVCLATGFYPDHVELSWWVNGKEVHSGVSTDPQPL KEQPALNDSRYCLSSRLRVSATFWQNPRNHFRCQVQFYGLSENDEWTQDRAKPVTQI VSAEAWGRADCGFTSESYQQGVLSATILYEILLGKATLYAVLVSALVLMAMVKRKDS RG | TCR 6, TCR 12 - Beta Native Homo sapiens (aa) |
| 53 | EPEVTQTPSHQVTQMGQEVILRCVPISNHLYFYWYRQILGQKVEFLVSFYNNEISEKSE IFDDQFSVERPDGSNFTLKIRSTKLEDSAMYFCASTTRSSYEQYFGPGTRLTVTEDLKN VFPPEVAVFEPSEAEISHTQKATLVCLATGFYPDHVELSWWVNGKEVHSGVCTDPQP LKEQPALNDSRYCLSSRLRVSATFWQNPRNHFRCQVQFYGLSENDEWTQDRAKPVT QIVSAEAWGRADCGFTSESYQQGVLSATILYEILLGKATLYAVLVSALVLMAMVKRK DSRG | TCR 6, TCR 12 - Beta Cysteine-modified Homo sapiens (aa) |
| 54 | ATGGATACCTGGCTCGTATGCTGGGCAATTTTTAGTCTCTTGAAAGCAGGACTCAC AGAACCTGAAGTCACCCAGACTCCCAGCCATCAGGTCACACAGATGGGACAGGA AGTGATCTTGCGCTGTGTCCCCATCTCTAATCACTTATACTTCTATTGGTACAGAC AAATCTTGGGGCAGAAAGTCGAGTTTCTGGTTTCCTTTTATAATAATGAAATCTCA GAGAAGTCTGAAATATTCGATGATCAATTCTCAGTTGAAAGGCCTGATGGATCAA ATTTTCACTCTGAAGATCCGGTCCACAAAGCTGGAGGACTCAGCCATGTACTTCTGT GCCAGCACAACGAGGAGCTCCTACGAGCAGTACTTCGGGCCGGGCACCAGGCTCA CGGTCACAGAGGACCTGAAAAACGTGTTCCCACCCGAGGTCGCTGTGTTTGAGCC ATCAGAAGCAGAGATCTCCCACACCCAAAAGGCCACACTGGTATGCCTGGCCACA GGCTTCTACCCCGACCACGTGGAGCTGAGCTGGTGGGTGAATGGGAAGGAGGTGC ACAGTGGGGTCTGCACAGACCCGCAGCCCCTCAAGGAGCAGCCCGCCCTCAATGA CTCCAGATACTGCCTGAGCAGCCGCCTGAGGGTCTCGGCCACCTTCTGGCAGAAC CCCCGCAACCACTTCCGCTGTCAAGTCCAGTTCTACGGGCTCTCGGAGAATGACG AGTGGACCCAGGATAGGGCCAAACCTGTCACCCAGATCGTCAGCGCCGAGGCCTG GGGTAGAGCAGACTGTGGCTTCACCTCCGAGTCTTACCAGCAAGGGGTCCTGTCT GCCACCATCCTCTATGAGATCTTGCTAGGGAAGGCCACCTTGTATGCCGTGCTGGT CAGTGCCCTCGTGCTGATGGCCATGGTCAAGAGAAAGGATTCCAGAGGC | TCR 6 - Beta Codon Optimized/Cysteine Modified Homo sapiens (nt) |
| 55 | ATGGATACCTGGCTCGTATGCTGGGCAATTTTTAGTCTCTTGAAAGCAGGACTCAC AGAACCTGAAGTCACCCAGACTCCCAGCCATCAGGTCACACAGATGGGACAGGA AGTGATCTTGCGCTGTGTCCCCATCTCTAATCACTTATACTTCTATTGGTACAGAC AAATCTTGGGGCAGAAAGTCGAGTTTCTGGTTTCCTTTTATAATAATGAAATCTCA GAGAAGTCTGAAATATTCGATGATCAATTCTCAGTTGAAAGGCCTGATGGATCAA ATTTTCACTCTGAAGATCCGGTCCACAAAGCTGGAGGACTCAGCCATGTACTTCTGT GCCAGCACAACGAGGAGCTCCTACGAGCAGTACTTCGGGCCGGGCACCAGGCTCA CGGTCACAGAGGACCTGAAAAACGTGTTCCCACCCGAGGTCGCTGTGTTTGAGCC ATCAGAAGCAGAGATCTCCCACACCCAAAAGGCCACACTGGTATGCCTGGCCACA GGCTTCTACCCCGACCACGTGGAGCTGAGCTGGTGGGTGAATGGGAAGGAGGTGC ACAGTGGGGTCAGCACAGACCCGCAGCCCCTCAAGGAGCAGCCCGCCCTCAATGA CTCCAGATACTGCCTGAGCAGCCGCCTGAGGGTCTCGGCCACCTTCTGGCAGAAC CCCCGCAACCACTTCCGCTGTCAAGTCCAGTTCTACGGGCTCTCGGAGAATGACG AGTGGACCCAGGATAGGGCCAAACCTGTCACCCAGATCGTCAGCGCCGAGGCCTG GGGTAGAGCAGACTGTGGCTTCACCTCCGAGTCTTACCAGCAAGGGGTCCTGTCT GCCACCATCCTCTATGAGATCTTGCTAGGGAAGGCCACCTTGTATGCCGTGCTGGT CAGTGCCCTCGTGCTGATGGCCATGGTCAAGAGAAAGGATTCCAGAGGC | TCR 6 - Beta Native Homo sapiens (nt) |
| 56 | GCGGCCGCCACCATGGATACCTGGCTCGTATGCTGGGCAATTTTTAGTCTCTTGAA AGCAGGACTCACAGAACCTGAAGTCACCCAGACTCCCAGCCATCAGGTCACACAG ATGGGACAGGAAGTGATCTTGCGCTGTGTCCCCATCTCTAATCACTTATACTTCTA TTGGTACAGACAAATCTTGGGGCAGAAAGTCGAGTTTCTGGTTTCCTTTTATAATA ATGAAATCTCAGAGAAGTCTGAAATATTCGATGATCAATTCTCAGTTGAAAGGCC TGATGGATCAAATTTTCACTCTGAAGATCCGGTCCACAAAGCTGGAGGACTCAGCC ATGTACTTCTGTGCCAGCACAACGAGGAGCTCCTACGAGCAGTACTTCGGGCCGG GCACCAGGCTCACGGTCACAGAGGACCTGAAAAACGTGTTCCCACCCGAGGTCGC TGTGTTTGAGCCATCAGAAGCAGAGATCTCCCACACCCAAAAGGCCACACTGGTA TGCCTGGCCACAGGCTTCTACCCCGACCACGTGGAGCTGAGCTGGTGGGTGAATG GGAAGGAGGTGCACAGTGGGGTCTGCACAGACCCGCAGCCCCTCAAGGAGCAGC CCGCCCTCAATGACTCCAGATACTGCCTGAGCAGCCGCCTGAGGGTCTCGGCCAC CTTCTGGCAGAACCCCCGCAACCACTTCCGCTGTCAAGTCCAGTTCTACGGGCTCT CGGAGAATGACGAGTGGACCCAGGATAGGGCCAAACCTGTCACCCAGATCGTCA GCGCCGAGGCCTGGGGTAGAGCAGACTGTGGCTTCACCTCCGAGTCTTACCAGCA AGGGGTCCTGTCTGCCACCATCCTCTATGAGATCTTGCTAGGGAAGGCCACCTTGT ATGCCGTGCTGGTCAGTGCCCTCGTGCTGATGGCCATGGTCAAGAGAAAGGATTC CAGAGGCGGATCCGGAGCTACCAACTTCTCTCTGCTGAAACAGGCAGGCGATGTG GAGGAAAATCCTGGGCCAATGAAGACATTTGCTGGATTTTCGTTCCTGTTTTTGTG GCTGCAGCTGGACTGTATGAGTAGAGGAGAGGATGGGAGCAGAGTCTTTTCCTG AGTGTCCGAGAGGGAGACAGCTCCGTTATAAACTGCACTTACACAGACAGCTCCT CCACCTACTTATACTGGTATAAGCAAGAACCTGGAGCAGGTCTCCAGTTGCTGAC | TCR 6 Codon-optimized/ cysteine-modified full sequence Homo sapiens (nt) |

SEQUENCE TABLE

| SEQ ID NO. | SEQUENCE | DESCRIPTION |
|---|---|---|
| | GTATATTTTTTCAAATATGGACATGAAACAAGACCAAAGACTCACTGTTCTATTGA<br>ATAAAAAGGATAAACATCTGTCTCTGCGCATTGCAGACACCCAGACTGGGGACTC<br>AGCTATCTACTTCTGTGCAGAGAGTATAAGAGGCTTTGGGAATGTGCTGCATTGCG<br>GGTCCGGCACTCAAGTGATTGTTTTACCACATATCCAGAACCCTGACCCTGCCGTG<br>TACCAGCTGAGAGACTCTAAATCCAGTGACAAGTCTGTCTGCCTATTCACCGATTT<br>TGATTCTCAAACAAATGTGTCACAAAGTAAGGATTCTGATGTGTATATCACAGAC<br>AAATGTGTGCTAGACATGAGGTCTATGGACTTCAAGAGCAACAGTGCTGTGGCCT<br>GGAGCAACAAATCTGACTTTGCATGTGCAAACGCCTTCAACAACAGCATTATTCC<br>AGAAGACACCTTCTTCCCCAGCCCAGAAAGTTCCTGTGATGTCAAGCTGGTCGAG<br>AAAAGCTTTGAAACAGATACGAACCTAAACTTTCAAAACCTGTCAGTGATTGGGT<br>TCCGAATCCTCCTCCTGAAAGTGGCCGGGTTTAATCTGCTCATGACGCTGCGGCTG<br>TGGTCTTCCTAAGGCGCGCC | |
| 57 | MDTWLVCWAIFSLLKAGLTEPEVTQTPSHQVTQMGQEVILRCVPISNHLYFYWYRQI<br>LGQKVEFLVSFYNNEISEKSEIFDDQFSVERPDGSNFTLKIRSTKLEDSAMYFCASTTRS<br>SYEQYFGPGTRLTVTEDLKNVFPPEVAVFEPSEAEISHTQKATLVCLATGFYPDHVELS<br>WWVNGKEVHSGVCTDPQPLKEQPALNDSRYCLSSRLRVSATFWQNPRNHFRCQVQF<br>YGLSENDEWTQDRAKPVTQIVSAEAWGRADCGFTSESYQQGVLSATILYEILLGKATL<br>YAVLVSALVLMAMVKRKDSRGGSGATNFSLLKQAGDVEENPGPMKTFAGFSFLFLW<br>LQLDCMSRGEDVEQSLFLSVREGDSSVINCTYTDSSSTYLYWYKQEPGAGLQLLTYIF<br>SNMDMKQDQRLTVLLNKKDKHLSLRIADTQTGDSAIYFCAESIRGFGNVLHCGSGTQ<br>VIVLPHIQNPDPAVYQLRDSKSSDKSVCLFTDFDSQTNVSQSKDSDVYITDKCVLDMR<br>SMDFKSNSAVAWSNKSDFACANAFNNSIIPEDTFFPSPESSCDVKLVEKSFETDTNLNF<br>QNLSVIGFRILLLKVAGFNLLMTLRLWSS | TCR 6<br>Full sequence<br>Cysteine-modified<br>Homo sapiens<br>(aa) |
| 58 | KNQVEQSPQSLIILEGKNCTLQCNYTVSPFSNLRWYKQDTGRGPVSLTIMTFSENTKSN<br>GRYTATLDADTKQSSLHITASQLSDSASYICVVSRDNYGQNFVFGPGTRLSVLPYIQNP<br>DPAVYQLRDSKSSDKSVCLFTDFDSQTNVSQSKDSDVYITDKTVLDMRSMDFKSNSA<br>VAWSNKSDFACANAFNNSIIPEDTFFPSPESSCDVKLVEKSFETDTNLNFQNLSVIGFRI<br>LLLKVAGFNLLMTLRLWSS | TCR 7/TCR 54 -<br>(E7)11 - alpha<br>Native<br>Homo sapiens<br>(aa) |
| 59 | KNQVEQSPQSLIILEGKNCTLQCNYTVSPFSNLRWYKQDTGRGPVSLTIMTFSENTKSN<br>GRYTATLDADTKQSSLHITASQLSDSASYICVVSRDNYGQNFVFGPGTRLSVLPYIQNP<br>DPAVYQLRDSKSSDKSVCLFTDFDSQTNVSQSKDSDVYITDKCVLDMRSMDFKSNSA<br>VAWSNKSDFACANAFNNSIIPEDTFFPSPESSCDVKLVEKSFETDTNLNFQNLSVIGFRI<br>LLLKVAGFNLLMTLRLWSS | TCR 7/TCR 54 -<br>(E7)11 - alpha<br>Cysteine-modified<br>Homo sapiens<br>(aa) |
| 60 | ATGAAAAAGCATCTGACGACCTTCTTGGTGATTTTGTGGCTTTATTTTTATAGGGG<br>GAATGGCAAAACCAAGTGGAGCAGAGTCCTCAGTCCCTGATCATCCTGGAGGGA<br>AGAACTGCACTCTTCAATGCAATTATACAGTGAGCCCCTTCAGCAACTTAAGGT<br>GGTATAAGCAAGATACTGGGAGAGGTCCTGTTTCCCTGACAATCATGACTTTCAGT<br>GAGAACACAAAGTCGAACGGAAGATATACAGCAACTCTGGATGCAGACACAAAG<br>CAAAGCTCTCTGCACATCACAGCCTCCCAGCTCAGCGATTCAGCCTCCTACATCTG<br>TGTGGTGAGCCGGGATAACTATGGTCAGAATTTTGTCTTTGGTCCCGGAACCAGAT<br>TGTCCGTGCTGCCCTATATCCAGAACCCTGACCCTGCCGTGTACCAGCTGAGAGAC<br>TCTAAATCCAGTGACAAGTCTGTCTGCCTATTCACCGATTTTGATTCTCAAACAAA<br>TGTGTCACAAAGTAAGGATTCTGATGTGTATATCACAGACAAAACTGTGCTAGAC<br>ATGAGGTCTATGGACTTCAAGAGCAACAGTGCTGTGGCCTGGAGCAACAAATCTG<br>ACTTTGCATGTGCAAACGCCTTCAACAACAGCATTATTCCAGAAGACACCTTCTTC<br>CCCAGCCCAGAAAGTTCCTGTGATGTCAAGCTGGTCGAGAAAAGCTTTGAAACAG<br>ATACGAACCTAAACTTTCAAAACCTGTCAGTGATTGGGTTCCGAATCCTCCTCCTG<br>AAAGTGGCCGGGTTTAATCTGCTCATGACGCTGCGGCTG | TCR 7 - (E7)11 -<br>alpha<br>Native<br>Homo sapiens<br>(nt) |
| 61 | ATGAAGAAACACCTGACCACCTTCCTGGTCATCCTGTGGCTGTACTTCTACAGAGG<br>GAACGGAAAGAATCAGGTGGAACAGAGTCCACAGTCACTGATCATTCTGGAGGG<br>CAAAAACTGCACTCTGCAGTGTAATTATACCGTGAGCCCATTTTCCAATCTGCGAT<br>GGTACAAGCAGGACACTGGACGAGGACCCGTGAGCCTGACCATTATGACATTCTC<br>CGAGAACACCAAGTCTAATGGCCGCTATACAGCCACTCTGGACGCTGATACTAAA<br>CAGTCTAGTCTGCATATCACCGCCTCTCAGCTGTCTGATAGTGCTTCATATATTTGC<br>GTGGTCAGTAGGGACAACTACGGGCAGAATTTCGTGTTTGGACCAGGAACCCGAC<br>TGTCCGTCCTGCCTTATATCCAGAACCCCGACCCTGCCGTGTACCAGCTGAGGGAC<br>TCTAAGTCAAGCGATAAAAGCGTGTGCCTGTTCACAGACTTTGATTCCCAGACTAA<br>TGTGAGCCAGTCCAAGGACTCTGACGTGTACATTACTGACAAATGCGTCCTGGAT<br>ATGCGCAGCATGGACTTTAAGTCTAACAGTGCAGTGGCCTGGTCTAACAAGAGTG<br>ATTTCGCTTGCGCAAACGCCTTTAACAATAGTATCATTCCCGAAGATACTTTCTTT<br>CCATCACCCGAGTCCTCTTGTGACGTGAAGCTGGTCGAAAATCATTCGAGACCG<br>ATACAAACCTGAATTTTCAGAACCTGTCTGTGATCGGGTTCCGGATTCTGCTGCTG<br>AAGGTCGCCGGATTCAATCTGCTGATGACACTGAGACTGTGGAGTTCA | TCR 7 - (E7)11 -<br>alpha<br>Codon-optimized/<br>cysteine-modified<br>Homo sapiens<br>(nt) |

SEQUENCE TABLE

| SEQ ID NO. | SEQUENCE | DESCRIPTION |
| --- | --- | --- |
| 62 | EPEVTQTPSHQVTQMGQEVILRCVPISNHLYFYWYRQILGQKVEFLVSFYNNEISEKSE IFDDQFSVERPDGSNFTLKIRSTKLEDSAMYFCAITDRTNYGYTFGSGTRLTVVEDLNK VFPPEVAVFEPSEAEISHTQKATLVCLATGFFPDHVELSWWVNGKEVHSGVSTDPQPL KEQPALNDSRYCLSSRLRVSATFWQNPRNHFRCQVQFYGLSENDEWTQDRAKPVTQI VSAEAWGRADCGFTSVSYQQGVLSATILYEILLGKATLYAVLVSALVLMAMVKRKD F | TCR 7/TCR 54 - (E7)11 -Beta Native *Homo sapiens* (aa) |
| 63 | EPEVTQTPSHQVTQMGQEVILRCVPISNHLYFYWYRQILGQKVEFLVSFYNNEISEKSE IFDDQFSVERPDGSNFTLKIRSTKLEDSAMYFCAITDRTNYGYTFGSGTRLTVVEDLNK VFPPEVAVFEPSEAEISHTQKATLVCLATGFFPDHVELSWWVNGKEVHSGVCTDPQPL KEQPALNDSRYCLSSRLRVSATFWQNPRNHFRCQVQFYGLSENDEWTQDRAKPVTQI VSAEAWGRADCGFTSVSYQQGVLSATILYEILLGKATLYAVLVSALVLMAMVKRKD F | TCR 7/TCR 54 - (E7)11 -Beta Cysteine-modified *Homo sapiens* (aa) |
| 64 | ATGGATACCTGGCTCGTATGCTGGGCAATTTTTAGTCTCTTGAAAGCAGGACTCAC AGAACCTGAAGTCACCCAGACTCCCAGCCATCAGGTCACACAGATGGGACAGGA AGTGATCTTGCGCTGTGTCCCCATCTCTAATCACTTATACTTCTATTGGTACAGAC AAATCTTGGGGCAGAAAGTCGAGTTTCTGGTTTCCTTTTATAATAATGAAATCTCA GAGAAGTCTGAAATATTCGATGATCAATTCTCAGTTGAAAGGCCTGATGAATCAA ATTTCACTCTGAAGATCCGGTCCACAAAGCTGGAGGACTCAGCCATGTACTTCTGT GCCATTACAGACCGCACTAACTATGGCTACACCTTCGGTTCGGGGACCAGGTTAA CCGTTGTAGAGGACCTGAACAAGGTGTTCCCACCCGAGGTCGCTGTGTTTGAGCC ATCAGAAGCAGAGATCTCCCACACCCAAAAGGCCACACTGGTGTGCCTGGCCACA GGCTTCTTCCCTGACCACGTGGAGCTGAGCTGGTGGGTGAATGGGAAGGAGGTGC ACAGTGGGGTCAGCACGGACCCGCAGCCCCTCAAGGAGCAGCCCGCCCTCAATGA CTCCAGATACTGCCTGAGCAGCCGCCTGAGGGTCTCGGCCACCTTCTGGCAGAAC CCCCGCAACCACTTCCGCTGTCAAGTCCAGTTCTACGGGCTCTCGGAGAATGACG AGTGGACCCAGGATAGGGCCAAACCCGTCACCCAGATCGTCAGCGCCGAGGCCTG GGGTAGAGCAGACTGTGGCTTTACCTCGGTGTCCTACCAGCAAGGGGTCCTGTCT GCCACCATCCTCTATGAGATCCTGCTAGGGAAGGCCACCCTGTATGCTGTGCTGGT CAGCGCCCTTGTGTTGATGGCCATGGTCAAGAGAAAGGATTTC | TCR 7 - (E7)11 - Beta Native *Homo sapiens* (nt) |
| 65 | ATGGACACCTGGCTGGTGTGCTGGGCAATCTTTAGTCTGCTGAAGGCCGGACTGA CCGAGCCTGAAGTGACTCAGACCCCATCCCACCAGGTCACACAGATGGGCCAGGA AGTGATCCTGCGGTGCGTGCCAATTTCCAACCATCTGTACTTCTATTGGTACAGAC AGATTCTGGGCCAGAAGGTGGAGTTCCTGGTCAGCTTTTATAACAACGAGATCTC AGAAAAGAGCGAGATTTTCGACGATCAGTTTTCAGTGGAAAGACCCGATGGGAGC AATTTCACCCTGAAGATCAGGAGTACAAAACTGGAGGATTCAGCAATGTACTTTT GCGCCATTACTGACCGCACCAACTATGGATACACCTTCGGCTCCGGGACACGACT GACTGTGGTCGAGGACCTGAATAAGGTGTTCCCCCCTGAAGTGGCTGTCTTTGAGC CTTCAGAGGCAGAAATCAGCCACACACAGAAAGCCACCCTGGTGTGCCTGGCTAC AGGCTTCTTTCCAGATCACGTGGAACTGAGCTGGTGGGTCAACGGCAAGGAGGTG CATTCCGGGGTCTGCACTGACCCACAGCCCCTGAAAGAGCAGCCCGCTCTGAATG ATAGCAGGTATTGCCTGAGCTCCCGGCTGAGAGTGTCCGCCACCTTTTGGCAGAA CCCTAGGAATCATTTCCGCTGTCAGGTGCAGTTTTACGGCCTGTCTGAAAACGACG AGTGGACCCAGGATCGAGCTAAGCCTGTGACACAGATCGTCAGCGCCGAAGCTTG GGGGCGCGCAGACTGCGGATTCACCAGCGTGTCCTACCAGCAGGGCGTCCTGTCC GCCACAATCCTGTATGAGATTCTGCTGGGGAAGGCTACTCTGTACGCAGTGCTGGT CTCGCTCTGGTGCTGATGGCAATGGTCAAGCGGAAAGACTTC | TCR 7 - (E7)11 - Beta Codon-optimized/ cysteine-modified *Homo sapiens* (nt) |
| 66 | GCGGCCGCCACCATGGACACCTGGCTGGTGTGCTGGGCAATCTTTAGTCTGCTGA AGGCCGGACTGACCGAGCCTGAAGTGACTCAGACCCCATCCCACCAGGTCACACA GATGGGCCAGGAAGTGATCCTGCGGTGCGTGCCAATTTCCAACCATCTGTACTTCT ATTGGTACAGACAGATTCTGGGCCAGAAGGTGGAGTTCCTGGTCAGCTTTTATAA CAACGAGATCTCAGAAAAGAGCGAGATTTTCGACGATCAGTTTTCAGTGGAAAGA CCCGATGGGAGCAATTTCACCCTGAAGATCAGGAGTACAAAACTGGAGGATTCAG CAATGTACTTTTGCGCCATTACTGACCGCACCAACTATGGATACACCTTCGGCTCC GGGACACGACTGACTGTGGTCGAGGACCTGAATAAGGTGTTCCCCCCTGAAGTGG CTGTCTTTGAGCCTTCAGAGGCAGAAATCAGCCACACACAGAAAGCCACCCTGGT GTGCCTGGCTACAGGCTTCTTTCCAGATCACGTGGAACTGAGCTGGTGGGTCAAC GGCAAGGAGGTGCATTCCGGGGTCTGCACTGACCCACAGCCCCTGAAAGAGCAG CCCGCTCTGAATGATAGCAGGTATTGCCTGAGCTCCCGGCTGAGAGTGTCCGCCAC CTTTTGGCAGAACCCTAGGAATCATTTCCGCTGTCAGGTGCAGTTTTACGGCCTGT CTGAAAACGACGAGTGGACCCAGGATCGAGCTAAGCCTGTGACACAGATCGTCAG CGCCGAAGCTTGGGGGCGCGCAGACTGCGGATTCACCAGCGTGTCCTACCAGCAG GGCGTCCTGTCCGCCACAATCCTGTATGAGATTCTGCTGGGGAAGGCTACTCTGTA CGCAGTGCTGGTCTCGCTCTGGTGCTGATGGCAATGGTCAAGCGGAAAGACTTC GGAAGCGGCGCAACAAACTTTTCCCTGCTGAAACAGGCCGGAGATGTGGAGGAA AATCCTGGCCCAATGAAGAAACCTGACCACCTTCCTGGTCATCCTGTGGCTGTA CTTCTACAGAGGGAACGGAAAGAATCAGGTGGAACAGAGTCCACAGTCACTGATC ATTCTGGAGGCAAAAACTGCACTCTGCAGTGTAATTATACCGTGAGCCCATTTTC CAATCTGCGATGGTACAAGCAGGACACTGGACGAGGACCCGTGAGCCTGACCATT | TCR 7 - (E7)11 - Codon-optimized/ cysteine-modified full sequence *Homo sapiens* (nt) |

| SEQ ID NO. | SEQUENCE | DESCRIPTION |
|---|---|---|
| | ATGACATTCTCCGAGAACACCAAGTCTAATGGCCGCTATACAGCCACTCTGGACG<br>CTGATACTAAACAGTCTAGTCTGCATATCACCGCCTCTCAGCTGTCTGATAGTGCT<br>TCATATATTTGCGTGGTCAGTAGGGACAACTACGGGCAGAATTTCGTGTTTGGACC<br>AGGAACCCGACTGTCCGTCCTGCCTTATATCCAGAACCCCGACCCTGCCGTGTACC<br>AGCTGAGGGACTCTAAGTCAAGCGATAAAAGCGTGTGCCTGTTCACAGACTTTGA<br>TTCCCAGACTAATGTGAGCCAGTCCAAGGACTCTGACGTGTACATTACTGACAAA<br>TGCGTCCTGGATATGCGCAGCATGGACTTTAAGTCTAACAGTGCAGTGGCCTGGTC<br>TAACAAGAGTGATTTCGCTTGCGCAAACGCCTTTAACAATAGTATCATTCCCGAAG<br>ATACTTTCTTTCCATCACCCGAGTCCTCTTGTGACGTGAAGCTGGTCGAAAAATCA<br>TTCGAGACCGATACAAACCTGAATTTTCAGAACCTGTCTGTGATCGGGTTCCGGAT<br>TCTGCTGCTGAAGGTCGCCGGATTCAATCTGCTGATGACACTGAGACTGTGGAGTT<br>CATGAGGCGCGCC | |
| 67 | MDTWLVCWAIFSLLKAGLTEPEVTQTPSHQVTQMGQEVILRCVPISNHLYFYWYRQI<br>LGQKVEFLVSFYNNEISEKSEIFDDQFSVERPDGSNFTLKIRSTKLEDSAMYFCAITDRT<br>NYGYTFGSGTRLTVVEDLNKVFPPEVAVFEPSEAEISHTQKATLVCLATGFFPDHVELS<br>WWVNGKEVHSGVCTDPQPLKEQPALNDSRYCLSSRLRVSATFWQNPRNHFRCQVQF<br>YGLSENDEWTQDRAKPVTQIVSAEAWGRADCGFTSVSYQQGVLSATILYEILLGKAT<br>LYAVLVSALVLMAMVKRKDFGSGATNFSLLKQAGDVEENPGPMKKHLTTFLVILWL<br>YFYRGNGKNQVEQSPQSLIILEGKNCTLQCNYTVSPFSNLRWYKQDTGRGPVSLTIMT<br>FSENTKSNGRYTATLDADTKQSSLHITASQLSDSASYICVVSRDNYGQNFVFGPGTRLS<br>VLPYIQNPDPAVYQLRDSKSSDKSVCLFTDFDSQTNVSQSKDSDVYITDKCVLDMRS<br>MDFKSNSAVAWSNKSDFACANAFNNSIIPEDTFFPSPESSCDVKLVEKSFETDTNLNFQ<br>NLSVIGFRILLLKVAGFNLLMTLRLWSS | TCR 7/TCR 54-<br>(E7) 11 -<br>Full sequence<br>Cysteine-<br>modified<br>Homo sapiens<br>(aa) |
| 68 | KQEVTQIPAALSVPEGENLVLNCSFTDSAIYNLQWFRQDPGKGLTSLLLIQSSQREQTS<br>GRLNASLDKSSGRSTLYIAASQPGDSATYLCAVRPLGNTPLVFGKGTRLSVIANIQNPD<br>PAVYQLRDSKSSDKSVCLFTDFDSQTNVSQSKDSDVYITDKTVLDMRSMDFKSNSAV<br>AWSNKSDFACANAFNNSIIPEDTFFPSPESSCDVKLVEKSFETDTNLNFQNLSVIGFRIL<br>LLKVAGFNLLMTLRLWSS | TCR 8 - Alpha<br>Native<br>Homo sapiens<br>(aa) |
| 69 | KQEVTQIPAALSVPEGENLVLNCSFTDSAIYNLQWFRQDPGKGLTSLLLIQSSQREQTS<br>GRLNASLDKSSGRSTLYIAASQPGDSATYLCAVRPLGNTPLVFGKGTRLSVIANIQNPD<br>PAVYQLRDSKSSDKSVCLFTDFDSQTNVSQSKDSDVYITDKCVLDMRSMDFKSNSAV<br>AWSNKSDFACANAFNNSIIPEDTFFPSPESSCDVKLVEKSFETDTNLNFQNLSVIGFRIL<br>LLKVAGFNLLMTLRLWSS | TCR 8 - Alpha<br>Cysteine-<br>modified<br>Homo sapiens<br>(aa) |
| 70 | ATGGAGACCCTCTTGGGCCTGCTTATCCTTTGGCTGCAGCTGCAATGGGTGAGCAG<br>CAAACAGGAGGTGACACAGATTCCTGCAGCTCTGAGTGTCCCAGAAGGAGAAAA<br>CTTGGTTCTCAACTGCAGTTTCACTGATAGCGCTATTTACAACCTCCAGTGGTTTA<br>GGCAGGACCCTGGGAAAGGTCTCACATCTCTGTTGCTTATTCAGTCAAGTCAGAG<br>AGAGCAAACAAGTGGAAGACTTAATGCCTCGCTGGATAAATCATCAGGACGTAGT<br>ACTTTATACATTGCAGCTTCTCAGCCTGGTGACTCAGCCACCTACCTCTGTGCTGT<br>GAGGCCTCTCGGAAACACACCTCTTGTCTTTGGAAAGGGCACAAGACTTTCTGTG<br>ATTGCAAATATCCAGAACCCTGACCCTGCCGTGTACCAGCTGAGAGACTCTAAAT<br>CCAGTGACAAGTCTGTCTGCCTATTCACCGATTTTGATTCTCAAACAAATGTGTCA<br>CAAAGTAAGGATTCTGATGTGTATATCACAGACAAACTGTGCTAGACATGAGGT<br>CTATGGACTTCAAGAGCAACAGTGCTGTGGCCTGGAGCAACAAATCTGACTTTGC<br>ATGTGCAAACGCCTTCAACAACAGCATTATTCCAGAAGACACCTTCTTCCCCAGCC<br>CAGAAAGTTCCTGTGATGTCAAGCTGGTCGAGAAAAGCTTTGAAACAGATACGAA<br>CCTAAACTTTCAAAACCTGTCAGTGATTGGGTTCCGAATCCTCCTCCTGAAAGTGG<br>CCGGGTTTAATCTGCTCATGACGCTGCGGCTC | TCR 8 - Alpha<br>Native<br>Homo sapiens<br>(nt) |
| 71 | ATGGAGACCCTCTTGGGCCTGCTTATCCTTTGGCTGCAGCTGCAATGGGTGAGCAG<br>CAAACAGGAGGTGACACAGATTCCTGCAGCTCTGAGTGTCCCAGAAGGAGAAAA<br>CTTGGTTCTCAACTGCAGTTTCACTGATAGCGCTATTTACAACCTCCAGTGGTTTA<br>GGCAGGACCCTGGGAAAGGTCTCACATCTCTGTTGCTTATTCAGTCAAGTCAGAG<br>AGAGCAAACAAGTGGAAGACTTAATGCCTCGCTGGATAAATCATCAGGACGTAGT<br>ACTTTATACATTGCAGCTTCTCAGCCTGGTGACTCAGCCACCTACCTCTGTGCTGT<br>GAGGCCTCTCGGAAACACACCTCTTGTCTTTGGAAAGGGCACAAGACTTTCTGTG<br>ATTGCAAATATCCAGAACCCTGACCCTGCCGTGTACCAGCTGAGAGACTCTAAAT<br>CCAGTGACAAGTCTGTCTGCCTATTCACCGATTTTGATTCTCAAACAAATGTGTCA<br>CAAAGTAAGGATTCTGATGTGTATATCACAGACAAATGCGTGCTAGACATGAGGT<br>CTATGGACTTCAAGAGCAACAGTGCTGTGGCCTGGAGCAACAAATCTGACTTTGC<br>ATGTGCAAACGCCTTCAACAACAGCATTATTCCAGAAGACACCTTCTTCCCCAGCC<br>CAGAAAGTTCCTGTGATGTCAAGCTGGTCGAGAAAAGCTTTGAAACAGATACGAA<br>CCTAAACTTTCAAAACCTGTCAGTGATTGGGTTCCGAATCCTCCTCCTGAAAGTGG<br>CCGGGTTTAATCTGCTCATGACGCTGCGGCTCTGGTCTTCC | TCR 8 - Alpha<br>Codon-optimized/<br>cysteine-modified<br>Homo sapiens<br>(nt) |

SEQUENCE TABLE

| SEQ ID NO. | SEQUENCE | DESCRIPTION |
|---|---|---|
| 72 | KVTQSSRYLVKRTGEKVFLECVQDMDHENMFWYRQDPGLGLRLIYFSYDVKMKEK GDIPEGYSVSREKKERFSLILESASTNQTSMYLCASSLWGASTDTQYFGPGTRLTVLED LKNVFPPEVAVFEPSEAEISHTQKATLVCLATGFYPDHVELSWWVNGKEVHSGVSTD PQPLKEQPALNDSRYCLSSRLRVSATFWQNPRNHFRCQVQFYGLSENDEWTQDRAKP VTQIVSAEAWGRADCGFTSESYQQGVLSATILYEILLGKATLYAVLVSALVLMAMVK RKDSRG | TCR 8 - Beta Native Homo sapiens (aa) |
| 73 | KVTQSSRYLVKRTGEKVFLECVQDMDHENMFWYRQDPGLGLRLIYFSYDVKMKEK GDIPEGYSVSREKKERFSLILESASTNQTSMYLCASSLWGASTDTQYFGPGTRLTVLED LKNVFPPEVAVFEPSEAEISHTQKATLVCLATGFYPDHVELSWWVNGKEVHSGVCTD PQPLKEQPALNDSRYCLSSRLRVSATFWQNPRNHFRCQVQFYGLSENDEWTQDRAKP VTQIVSAEAWGRADCGFTSESYQQGVLSATILYEILLGKATLYAVLVSALVLMAMVK RKDSRG | TCR 8 - Beta Cysteine-modified Homo sapiens (aa) |
| 74 | ATGGGAATCAGGCTCCTCTGTCGTGTGGCCTTTTGTTTCCTGGCTGTAGGCCTCGT AGATGTGAAAGTAACCCAGAGCTCGAGATATCTAGTCAAAAGGACGGGAGAGAA AGTTTTTCTGGAATGTGTCCAGGATATGGACCATGAAAATATGTTCTGGTATCGAC AAGACCCAGGTCTGGGGCTACGGCTGATCTATTTCTCATATGATGTTAAAATGAA AGAAAAAGGAGATATTCCTGAGGGGTACAGTGTCTCTAGAGAAGAAGGAGCG CTTCTCCCTGATTCTGGAGTCCGCCAGCACCAACCAGACATCTATGTACCTCTGTG CCAGCAGTTTATGGGGGCTAGCACAGATACGCAGTATTTTGGCCCAGGCACCCG GCTGACAGTGCTCGAGGACCTGAAAAACGTGTTCCCACCCGAGGTCGCTGTGTTT GAGCCATCAGAAGCAGAGATCTCCCACACCCAAAAGGCCACACTGGTATGCCTGG CCACAGGCTTCTACCCCGACCACGTGGAGCTGAGCTGGTGGGTGAATGGGAAGGA GGTGCACAGTGGGGTCAGCACAGACCCGCAGCCCTCAAGGAGCAGCCCGCCCTC AATGACTCCAGATACTGCCTGAGCAGCCGCCTGAGGGTCTCGGCCACCTTCTGGC AGAACCCCCGCAACCACTTCCGCTGTCAAGTCCAGTTCTACGGGCTCTCGGAGAA TGACGAGTGGACCCAGGATAGGGCCAAACCTGTCACCCAGATCGTCAGCGCCGAG GCCTGGGGTAGAGCAGACTGTGGCTTCACCTCCGAGTCTTACCAGCAAGGGGTCC TGTCTGCCACCATCCTCTATGAGATCTTGCTAGGGAAGGCCACCTTGTATGCCGTG CTGGTCAGTGCCCTCGTGCTGATGGCCATGGTCAAGAGAAAGGATTCCAGAGGC | TCR 8 - Beta Native Homo sapiens (nt) |
| 75 | ATGGGAATCAGGCTCCTCTGTCGTGTGGCCTTTTGTTTCCTGGCTGTAGGCCTCGT AGATGTGAAAGTAACCCAGAGCTCGAGATATCTAGTCAAAAGGACGGGAGAGAA AGTTTTTCTGGAATGTGTCCAGGATATGGACCATGAAAATATGTTCTGGTATCGAC AAGACCCAGGTCTGGGGCTACGGCTGATCTATTTCTCATATGATGTTAAAATGAA AGAAAAAGGAGATATTCCTGAGGGGTACAGTGTCTCTAGAGAAGAAGGAGCG CTTCTCCCTGATTCTGGAGTCCGCCAGCACCAACCAGACATCTATGTACCTCTGTG CCAGCAGTTTATGGGGGCTAGCACAGATACGCAGTATTTTGGCCCAGGCACCCG GCTGACAGTGCTCGAGGACCTGAAAAACGTGTTCCCACCCGAGGTCGCTGTGTTT GAGCCATCAGAAGCAGAGATCTCCCACACCCAAAAGGCCACACTGGTATGCCTGG CCACAGGCTTCTACCCCGACCACGTGGAGCTGAGCTGGTGGGTGAATGGGAAGGA GGTGCACAGTGGGGTCTGTACAGACCCGCAGCCCTCAAGGAGCAGCCCGCCCTC AATGACTCCAGATACTGCCTGAGCAGCCGCCTGAGGGTCTCGGCCACCTTCTGGC AGAACCCCCGCAACCACTTCCGCTGTCAAGTCCAGTTCTACGGGCTCTCGGAGAA TGACGAGTGGACCCAGGATAGGGCCAAACCTGTCACCCAGATCGTCAGCGCCGAG GCCTGGGGTAGAGCAGACTGTGGCTTCACCTCCGAGTCTTACCAGCAAGGGGTCC TGTCTGCCACCATCCTCTATGAGATCTTGCTAGGGAAGGCCACCTTGTATGCCGTG CTGGTCAGTGCCCTCGTGCTGATGGCCATGGTCAAGAGAAAGGATTCCAGAGGC | TCR 8 - Beta Codon-optimized/ cysteine-modified Homo sapiens (nt) |
| 76 | GCGGCCGCCACCATGGGAATCAGGCTCCTCTGTCGTGTGGCCTTTTGTTTCCTGGC TGTAGGCCTCGTAGATGTGAAAGTAACCCAGAGCTCGAGATATCTAGTCAAAAGG ACGGGAGAGAAAGTTTTTCTGGAATGTGTCCAGGATATGGACCATGAAAATATGT TCTGGTATCGACAAGACCCAGGTCTGGGGCTACGGCTGATCTATTTCTCATATGAT GTTAAAATGAAAGAAAAAGGAGATATTCCTGAGGGGTACAGTGTCTCTAGAGAG AAGAAGGAGCGCTTCTCCCTGATTCTGGAGTCCGCCAGCACCAACCAGACATCTA TGTACCTCTGTGCCAGCAGTTTATGGGGGCTAGCACAGATACGCAGTATTTTGGC CCAGGCACCCGGCTGACAGTGCTCGAGGACCTGAAAAACGTGTTCCCACCCGAGG TCGCTGTGTTTGAGCCATCAGAAGCAGAGATCTCCCACACCCAAAAGGCCACACT GGTATGCCTGGCCACAGGCTTCTACCCCGACCACGTGGAGCTGAGCTGGTGGGTG AATGGGAAGGAGGTGCACAGTGGGGTCTGTACAGACCCGCAGCCCCTCAAGGAG CAGCCCGCCCTCAATGACTCCAGATACTGCCTGAGCAGCCGCCTGAGGGTCTCGG CCACCTTCTGGCAGAACCCCCGCAACCACTTCCGCTGTCAAGTCCAGTTCTACGGG CTCTCGGAGAATGACGAGTGGACCCAGGATAGGGCCAAACCTGTCACCCAGATCG TCAGCGCCGAGGCCTGGGGTAGAGCAGACTGTGGCTTCACCTCCGAGTCTTACCA GCAAGGGGTCCTGTCTGCCACCATCCTCTATGAGATCTTGCTAGGGAAGGCCACCT TGTATGCCGTGCTGGTCAGTGCCCTCGTGCTGATGGCCATGGTCAAGAGAAAGGA TTCCAGAGGCGGATCCGGAGCTACCAACTTCTCTCTGCTGAAACAGGCAGGCGAT GTGGAGGAAAATCCTGGGCCAATGGAGACCCTCTTGGGCCTGCTTATCCTTTGGCT GCAGCTGCAATGGGTGAGCAGCAAACAGGAGGTGACACAGATTCCTGCAGCTCTG AGTGTCCCAGAAGGAGAAAACTTGGTTCTCAACTGCAGTTTCACTGATAGCGCTA TTTACAACCTCCAGTGGTTTAGGCAGGACCCTGGGAAAGGTCTCACATCTCTGTTG | TCR 8 Codon-optimized/ cysteine-modified full sequence Homo sapiens (nt) |

-continued

SEQUENCE TABLE

| SEQ ID NO. | SEQUENCE | DESCRIPTION |
|---|---|---|
| | CTTATTCAGTCAAGTCAGAGAGAGCAAACAAGTGGAAGACTTAATGCCTCGCTGG<br>ATAAATCATCAGGACGTAGTACTTTATACATTGCAGCTTCTCAGCCTGGTGACTCA<br>GCCACCTACCTCTGTGCTGTGAGGCCTCTCGGAAACACACCTCTTGTCTTTGGAAA<br>GGGCACAAGACTTTCTGTGATTGCAAATATCCAGAACCCTGACCCTGCCGTGTACC<br>AGCTGAGAGACTCTAAATCCAGTGACAAGTCTGTCTGCCTATTCACCGATTTTGAT<br>TCTCAAACAAATGTGTCACAAAGTAAGGATTCTGATGTGTATATCACAGACAAAT<br>GCGTGCTAGACATGAGGTCTATGGACTTCAAGAGCAACAGTGCTGTGGCCTGGAG<br>CAACAAATCTGACTTTGCATGTGCAAACGCCTTCAACAACAGCATTATTCCAGAA<br>GACACCTTCTTCCCCAGCCCAGAAAGTTCCTGTGATGTCAAGCTGGTCGAGAAAA<br>GCTTTGAAACAGATACGAACCTAAACTTTCAAACCTGTCAGTGATTGGGTTCCG<br>AATCCTCCTCCTGAAAGTGGCCGGGTTTAATCTGCTCATGACGCTGCGGCTCTGGT<br>CTTCCTAAGGCGCGCC | |
| 77 | MGIRLLCRVAFCFLAVGLVDVKVTQSSRYLVKRTGEKVFLECVQDMDHENMFWYR<br>QDPGLGLRLIYFSYDVKMKEKGDIPEGYSVSREKKERFSLILESASTNQTSMYLCASSL<br>WGASTDTQYFGPGTRLTVLEDLKNVFPPEVAVFEPSEAEISHTQKATLVCLATGFYPD<br>HVELSWWVNGKEVHSGVCTDPQPLKEQPALNDSRYCLSSRLRVSATFWQNPRNHFR<br>CQVQFYGLSENDEWTQDRAKPVTQIVSAEAWGRADCGFTSESYQQGVLSATILYEILL<br>GKATLYAVLVSALVLMAMVKRKDSRGGSGATNFSLLKQAGDVEENPGPMETLLGLL<br>ILWLQLQWVSSKQEVTQIPAALSVPEGENLVLNCSFTDSAIYNLQWFRQDPGKGLTSL<br>LLIQSSQREQTSGRLNASLDKSSGRSTLYIAASQPGDSATYLCAVRPLGNTPLVFGKGT<br>RLSVIANIQNPDPAVYQLRDSKSSDKSVCLFTDFDSQTNVSQSKDSDVYITDKCVLDM<br>RSMDFKSNSAVAWSNKSDFACANAFNNSIIPEDTFFPSPESSCDVKLVEKSFETDTNLN<br>FQNLSVIGFRILLLKVAGFNLLMTLRLWSS | TCR 8<br>Full sequence<br>Cysteine-<br>modified<br>*Homo sapiens*<br>(aa) |
| 78 | AQKITQTQPGMFVQEKEAVTLDCTYDTSDPSYGLFWYKQPSSGEMIFLIYQGSYDQQ<br>NATEGRYSLNFQKARKSANLVISASQLGDSAMYFCAMRTAGGTSYGKLTFGQGTILT<br>VHPNIQNPDPAVYQLRDSKSSDKSVCLFTDFDSQTNVSQSKDSDVYITDKTVLDMRS<br>MDFKSNSAVAWSNKSDFACANAFNNSIIPEDTFFPSPESSCDVKLVEKSFETDTNLNFQ<br>NLSVIGFRILLLKVAGFNLLMTLRLWSS | TCR 9 - Alpha<br>Native<br>*Homo sapiens*<br>(aa) |
| 79 | AQKITQTQPGMFVQEKEAVTLDCTYDTSDPSYGLFWYKQPSSGEMIFLIYQGSYDQQ<br>NATEGRYSLNFQKARKSANLVISASQLGDSAMYFCAMRTAGGTSYGKLTFGQGTILT<br>VHPNIQNPDPAVYQLRDSKSSDKSVCLFTDFDSQTNVSQSKDSDVYITDKCVLDMRS<br>MDFKSNSAVAWSNKSDFACANAFNNSIIPEDTFFPSPESSCDVKLVEKSFETDTNLNFQ<br>NLSVIGFRILLLKVAGFNLLMTLRLWSS | TCR 9 - Alpha<br>Cysteine-<br>modified<br>*Homo sapiens*<br>(aa) |
| 80 | ATGTCACTTTCTAGCCTGCTGAAGGTGGTCACAGCTTCACTGTGGCTAGGACCTGG<br>CATTGCCCAGAAGATAACTCAAACCCAACCAGGAATGTTCGTGCAGGAAAAGGA<br>GGCTGTGACTCTGGACTGCACATATGACACCAGTGATCCAAGTTATGGTCTATTCT<br>GGTACAAGCAGCCCAGCAGTGGGGAAATGATTTTTCTTATTTATCAGGGGTCTTAT<br>GACCAGCAAAATGCAACAGAAGGTCGCTACTCATTGAATTTCCAGAAGGCAAGAA<br>AATCCGCCAACCTTGTCATCTCCGCTTCACAACTGGGGGACTCAGCAATGTACTTC<br>TGTGCAATGAGAACTGCTGGTGGTACTAGCTATGGAAAGCTGACATTTGGACAAG<br>GGACCATCTTGACTGTCCATCCAAATATCCAGAACCCTGACCCTGCCGTGTACCAG<br>CTGAGAGACTCTAAATCCAGTGACAAGTCTGTCTGCCTATTCACCGATTTTGATTC<br>TCAAACAAATGTGTCACAAAGTAAGGATTCTGATGTGTATATCACAGACAAAACT<br>GTGCTAGACATGAGGTCTATGGACTTCAAGAGCAACAGTGCTGTGGCCTGGAGCA<br>ACAAATCTGACTTTGCATGTGCAAACGCCTTCAACAACAGCATTATTCCAGAAGA<br>CACCTTCTTCCCCAGCCCAGAAAGTTCCTGTGATGTCAAGCTGGTCGAGAAAAGCT<br>TTGAAACAGATACGAACCTAAACTTTCAAACCTGTCAGTGATTGGGTTCCGAAT<br>CCTCCTCCTGAAAGTGGCCGGGTTTAATCTGCTCATGACGCTGCGGCTG | TCR 9 - Alpha<br>Native<br>*Homo sapiens*<br>(nt) |
| 81 | ATGTCACTTTCTAGCCTGCTGAAGGTGGTCACAGCTTCACTGTGGCTAGGACCTGG<br>CATTGCCCAGAAGATAACTCAAACCCAACCAGGAATGTTCGTGCAGGAAAAGGA<br>GGCTGTGACTCTGGACTGCACATATGACACCAGTGATCCAAGTTATGGTCTATTCT<br>GGTACAAGCAGCCCAGCAGTGGGGAAATGATTTTTCTTATTTATCAGGGGTCTTAT<br>GACCAGCAAAATGCAACAGAAGGTCGCTACTCATTGAATTTCCAGAAGGCAAGAA<br>AATCCGCCAACCTTGTCATCTCCGCTTCACAACTGGGGGACTCAGCAATGTACTTC<br>TGTGCAATGAGAACTGCTGGTGGTACTAGCTATGGAAAGCTGACATTTGGACAAG<br>GGACCATCTTGACTGTCCATCCAAATATCCAGAACCCTGACCCTGCCGTGTACCAG<br>CTGAGAGACTCTAAATCCAGTGACAAGTCTGTCTGCCTATTCACCGATTTTGATTC<br>TCAAACAAATGTGTCACAAAGTAAGGATTCTGATGTGTATATCACAGACAAATGT<br>GTGCTAGACATGAGGTCTATGGACTTCAAGAGCAACAGTGCTGTGGCCTGGAGCA<br>ACAAATCTGACTTTGCATGTGCAAACGCCTTCAACAACAGCATTATTCCAGAAGA<br>CACCTTCTTCCCCAGCCCAGAAAGTTCCTGTGATGTCAAGCTGGTCGAGAAAAGCT<br>TTGAAACAGATACGAACCTAAACTTTCAAACCTGTCAGTGATTGGGTTCCGAAT<br>CCTCCTCCTGAAAGTGGCCGGGTTTAATCTGCTCATGACGCTGCGGCTGTGGTCTT<br>CC | TCR 9 - Alpha<br>Codon-optimized/<br>cysteine-modified<br>*Homo sapiens*<br>(nt) |

SEQUENCE TABLE

| SEQ ID NO. | SEQUENCE | DESCRIPTION |
|---|---|---|
| 82 | NAGVTQTPKFRVLKTGQSMTLLCAQDMNHEYMYWYRQDPGMGLRLIHYSVGEGTT AKGEVPDGYNVSRLKKQNFLLGLESAAPSQTSVYFCASSYFGTAYEQYFGPGTRLTV TEDLKNVFPPEVAVFEPSEAEISHTQKATLVCLATGFYPDHVELSWWVNGKEVHSGV STDPQPLKEQPALNDSRYCLSSRLRVSATFWQNPRNHFRCQVQFYGLSENDEWTQDR AKPVTQIVSAEAWGRADCGFTSESYQQGVLSATILYEILLGKATLYAVLVSALVLMA MVKRKDSRG | TCR 9 - Beta Native Homo sapiens (aa) |
| 83 | NAGVTQTPKFRVLKTGQSMTLLCAQDMNHEYMYWYRQDPGMGLRLIHYSVGEGTT AKGEVPDGYNVSRLKKQNFLLGLESAAPSQTSVYFCASSYFGTAYEQYFGPGTRLTV TEDLKNVFPPEVAVFEPSEAEISHTQKATLVCLATGFYPDHVELSWWVNGKEVHSGV CTDPQPLKEQPALNDSRYCLSSRLRVSATFWQNPRNHFRCQVQFYGLSENDEWTQDR AKPVTQIVSAEAWGRADCGFTSESYQQGVLSATILYEILLGKATLYAVLVSALVLMA MVKRKDSRG | TCR 9 - Beta Cysteine-modified Homo sapiens (aa) |
| 84 | ATGAGCCTCGGGCTCCTGTGCTGTGGGGCCTTTTCTCTCCTGTGGGCAGGTCCAGT GAATGCTGGTGTCACTCAGACCCCAAAATTCCGGGTCCTGAAGACAGGACAGAGC ATGACACTGCTGTGTGCCCAGGATATGAACCATGAATACATGTACTGGTATCGAC AAGACCCAGGCATGGGGCTGAGGCTGATTCATTACTCAGTTGGTGAGGGTACAAC TGCCAAAGGAGAGGTCCCTGATGGCTACAATGTCTCCAGATTAAAAAAACAGAAT TTCCTGCTGGGGTTGGAGTCGGCTGCTCCCTCCCAAACATCTGTGTACTTCTGTGC CAGCAGTTACTTCGGGACAGCCTACGAGCAGTACTTCGGGCCGGGCACCAGGCTC ACGGTCACAGAGGACCTGAAAAACGTGTTCCCACCCGAGGTCGCTGTGTTTGAGC CATCAGAAGCAGAGATCTCCCACACCCAAAAGGCCACACTGGTGTGCCTGGCCAC AGGCTTCTACCCCGACCACGTGGAGCTGAGCTGGTGGGTGAATGGGAAGGAGGTG CACAGTGGGGTCAGCACAGACCCGCAGCCCCTCAAGGAGCAGCCCGCCCTCAATG ACTCCAGATACTGCCTGAGCAGCCGCCTGAGGGTCTCGGCCACCTTCTGGCAGAA CCCCCGCAACCACTTCCGCTGTCAAGTCCAGTTCTACGGGCTCTCGGAGAATGACG AGTGGACCCAGGATAGGGCCAAACCTGTCACCCAGATCGTCAGCGCCGAGGCCTG GGGTAGAGCAGACTGTGGCTTCACCTCCGAGTCTTACCAGCAAGGGGTCCTGTCT GCCACCATCCTCTATGAGATCTTGCTAGGGAAGGCCACCTTGTATGCCGTGCTGGT CAGTGCCCTCGTGCTGATGGCCATGGTCAAGAGAAAGGATTCCAGAGGC | TCR 9 - Beta Native Homo sapiens (nt) |
| 85 | ATGAGCCTCGGGCTCCTGTGCTGTGGGGCCTTTTCTCTCCTGTGGGCAGGTCCAGT GAATGCTGGTGTCACTCAGACCCCAAAATTCCGGGTCCTGAAGACAGGACAGAGC ATGACACTGCTGTGTGCCCAGGATATGAACCATGAATACATGTACTGGTATCGAC AAGACCCAGGCATGGGGCTGAGGCTGATTCATTACTCAGTTGGTGAGGGTACAAC TGCCAAAGGAGAGGTCCCTGATGGCTACAATGTCTCCAGATTAAAAAAACAGAAT TTCCTGCTGGGGTTGGAGTCGGCTGCTCCCTCCCAAACATCTGTGTACTTCTGTGC CAGCAGTTACTTCGGGACAGCCTACGAGCAGTACTTCGGGCCGGGCACCAGGCTC ACGGTCACAGAGGACCTGAAAAACGTGTTCCCACCCGAGGTCGCTGTGTTTGAGC CATCAGAAGCAGAGATCTCCCACACCCAAAAGGCCACACTGGTGTGCCTGGCCAC AGGCTTCTACCCCGACCACGTGGAGCTGAGCTGGTGGGTGAATGGGAAGGAGGTG CACAGTGGGGTCTGTACAGACCCGCAGCCCCTCAAGGAGCAGCCCGCCCTCAATG ACTCCAGATACTGCCTGAGCAGCCGCCTGAGGGTCTCGGCCACCTTCTGGCAGAA CCCCCGCAACCACTTCCGCTGTCAAGTCCAGTTCTACGGGCTCTCGGAGAATGACG AGTGGACCCAGGATAGGGCCAAACCTGTCACCCAGATCGTCAGCGCCGAGGCCTG GGGTAGAGCAGACTGTGGCTTCACCTCCGAGTCTTACCAGCAAGGGGTCCTGTCT GCCACCATCCTCTATGAGATCTTGCTAGGGAAGGCCACCTTGTATGCCGTGCTGGT CAGTGCCCTCGTGCTGATGGCCATGGTCAAGAGAAAGGATTCCAGAGGC | TCR 9 - Beta Codon-optimized/ cysteine-modified Homo sapiens (nt) |
| 86 | GCGGCCGCCACCATGAGCCTCGGGCTCCTGTGCTGTGGGGCCTTTTCTCTCCTGTG GGCAGGTCCAGTGAATGCTGGTGTCACTCAGACCCCAAAATTCCGGGTCCTGAAG ACAGGACAGAGCATGACACTGCTGTGTGCCCAGGATATGAACCATGAATACATGT ACTGGTATCGACAAGACCCAGGCATGGGGCTGAGGCTGATTCATTACTCAGTTGG TGAGGGTACAACTGCCAAAGGAGAGGTCCCTGATGGCTACAATGTCTCCAGATTA AAAAAACAGAATTTCCTGCTGGGGTTGGAGTCGGCTGCTCCCTCCCAAACATCTGT GTACTTCTGTGCCAGCAGTTACTTCGGGACAGCCTACGAGCAGTACTTCGGGCCG GGCACCAGGCTCACGGTCACAGAGGACCTGAAAAACGTGTTCCCACCCGAGGTCG CTGTGTTTGAGCCATCAGAAGCAGAGATCTCCCACACCCAAAAGGCCACACTGGT GTGCCTGGCCACAGGCTTCTACCCCGACCACGTGGAGCTGAGCTGGTGGGTGAAT GGGAAGGAGGTGCACAGTGGGGTCTGTACAGACCCGCAGCCCCTCAAGGAGCAG CCCGCCCTCAATGACTCCAGATACTGCCTGAGCAGCCGCCTGAGGGTCTCGGCCA CCTTCTGGCAGAACCCCCGCAACCACTTCCGCTGTCAAGTCCAGTTCTACGGGCTC TCGGAGAATGACGAGTGGACCCAGGATAGGGCCAAACCTGTCACCCAGATCGTCA GCGCCGAGGCCTGGGGTAGAGCAGACTGTGGCTTCACCTCCGAGTCTTACCAGCA AGGGGTCCTGTCTGCCACCATCCTCTATGAGATCTTGCTAGGGAAGGCCACCTTGT ATGCCGTGCTGGTCAGTGCCCTCGTGCTGATGGCCATGGTCAAGAGAAAGGATTC CAGAGGCGGATCCGGAGCTACCAACTTCTCTCTGCTGAAACAGGCAGGCGATGTG GAGGAAAATCCTGGGCCAATGTCACTTTCTAGCCTGCTGAAGGTGGTCACAGCTT CACTGTGGCTAGGACCTGGCATTGCCCAGAAGATAACTCAAACCCAACCAGGAAT GTTCGTGCAGGAAAAGGAGGCTGTGACTCTGGACTGCACATATGACACCAGTGAT CCAAGTTATGGTCTATTCTGGTACAAGCAGCCCAGCAGTGGGGAAATGATTTTTCT | TCR 9 - Codon-optimized/ cysteine-modified full sequence Homo sapiens (nt) |

| SEQ ID NO. | SEQUENCE | DESCRIPTION |
|---|---|---|
| | TATTTATCAGGGGTCTTATGACCAGCAAAATGCAACAGAAGGTCGCTACTCATTG<br>AATTTCCAGAAGGCAAGAAAATCCGCCAACCTTGTCATCTCCGCTTCACAACTGG<br>GGGACTCAGCAATGTACTTCTGTGCAATGAGAACTGCTGGTGGTACTAGCTATGG<br>AAAGCTGACATTTGGACAAGGGACCATCTTGACTGTCCATCCAAATATCCAGAAC<br>CCTGACCCTGCCGTGTACCAGCTGAGAGACTCTAAATCCAGTGACAAGTCTGTCTG<br>CCTATTCACCGATTTTGATTCTCAAACAAATGTGTCACAAAGTAAGGATTCTGATG<br>TGTATATCACAGACAAATGTGTGCTAGACATGAGGTCTATGGACTTCAAGAGCAA<br>CAGTGCTGTGGCCTGGAGCAACAAATCTGACTTTGCATGTGCAAACGCCTTCAAC<br>AACAGCATTATTCCAGAAGACACCTTCTTCCCCAGCCCAGAAAGTTCCTGTGATGT<br>CAAGCTGGTCGAGAAAAGCTTTGAAACAGATACGAACCTAAACTTTCAAAACCTG<br>TCAGTGATTGGGTTCCGAATCCTCCTCCTGAAAGTGGCCGGGTTTAATCTGCTCAT<br>GACGCTGCGGCTGTGGTCTTCCTAAGGCGCGCC | |
| 87 | MSLGLLCCGAFSLLWAGPVNAGVTQTPKFRVLKTGQSMTLLCAQDMNHEYMYWYR<br>QDPGMGLRLIHYSVGEGTTAKGEVPDGYNVSRLKKQNFLLGLESAAPSQTSVYFCAS<br>SYFGTAYEQYFGPGTRLTVTEDLKNVFPPEVAVFEPSEAEISHTQKATLVCLATGFYPD<br>HVELSWWVNGKEVHSGVCTDPQPLKEQPALNDSRYCLSSRLRVSATFWQNPRNHFR<br>CQVQFYGLSENDEWTQDRAKPVTQIVSAEAWGRADCGFTSESYQQGVLSATILYEILL<br>GKATLYAVLVSALVLMAMVKRKDSRGGSGATNFSLLKQAGDVEENPGPMSLSSLLK<br>VVTASLWLGPGIAQKITQTQPGMFVQEKEAVTLDCTYDTSDPSYGLFWYKQPSSGEM<br>IFLIYQGSYDQQNATEGRYSLNFQKARKSANLVISASQLGDSAMYFCAMRTAGGTSY<br>GKLTFGQGTILTVHPNIQNPDPAVYQLRDSKSSDKSVCLFTDFDSQTNVSQSKDSDVYI<br>TDKCVLDMRSMDFKSNSAVAWSNKSDFACANAFNNSIIPEDTFFPSPESSCDVKLVEK<br>SFETDTNLNFQNLSVIGFRILLLKVAGFNLLMTLRLWSS | TCR 9 -<br>Full sequence<br>Cysteine-<br>modified<br>*Homo sapiens*<br>(aa) |
| 88 | RKEVEQDPGPFNVPEGATVAFNCTYSNSASQSFFWYRQDCRKEPKLLMSVYSSGNED<br>GRFTAQLNRASQYISLLIRDSKLSDSATYLCVVNFPSRGAGGTSYGKLTFGQGTILTVH<br>PNIQKPDPAVYQLRDSKSSDKSVCLFTDFDSQTNVSQSKDSDVYITDKTVLDMRSMDF<br>KSNSAVAWSNKSDFACANAFNNSIIPADTFFPSPESSCDVKLVEKSFETDTNLNFQNLS<br>VIGFRILLLKVAGFNLLMTLRLWSS | TCR 10 - Alpha<br>Native<br>*Homo sapiens*<br>(aa) |
| 89 | RKEVEQDPGPFNVPEGATVAFNCTYSNSASQSFFWYRQDCRKEPKLLMSVYSSGNED<br>GRFTAQLNRASQYISLLIRDSKLSDSATYLCVVNFPSRGAGGTSYGKLTFGQGTILTVH<br>PNIQKPDPAVYQLRDSKSSDKSVCLFTDFDSQTNVSQSKDSDVYITDKCVLDMRSMDF<br>KSNSAVAWSNKSDFACANAFNNSIIPADTFFPSPESSCDVKLVEKSFETDTNLNFQNLS<br>VIGFRILLLKVAGFNLLMTLRLWSS | TCR 10 - Alpha<br>Cysteine-<br>modified<br>*Homo sapiens*<br>(aa) |
| 90 | ATGATGATATCCTTGAGAGTTTTACTGGTGATCCTGTGGCTTCAGTTAAGCTGGGT<br>TTGGAGCCAACGGAAGGAGGTGGAGCAGGATCCTGGACCCTTCAATGTTCCAGAG<br>GGAGCCACTGTCGCTTTCAACTGTACTTACAGCAACAGTGCTTCTCAGTCTTTCTT<br>CTGGTACAGACAGGATTGCAGGAAAGAACCTAAGTTGCTGATGTCCGTATACTCC<br>AGTGGTAATGAAGATGGAAGGTTTACAGCACAGCTCAATAGAGCCAGCCAGTATA<br>TTTCCCTGCTCATCAGAGACTCCAAGCTCAGTGATTCAGCCACCTACCTCTGTGTG<br>GTGAACTTCCCTTCTCGGGGTGCTGGTGGTACTAGCTATGGAAAGCTGACATTTGG<br>ACAAGGGACCATCTTGACTGTCCATCCAAATATCCAGAAGCCTGACCCTGCCGTG<br>TACCAGCTGAGAGACTCTAAATCCAGTGACAAGTCTGTCTGCCTATTCACCGATTT<br>TGATTCTCAAACAAATGTGTCACAAAGTAAGGATTCTGATGTGTATATCACAGAC<br>AAAACTGTGCTAGACATGAGGTCTATGGACTTCAAGAGCAACAGTGCTGTGGCCT<br>GGAGCAACAAATCTGACTTTGCATGTGCAAACGCCTTCAACAACAGCATTATTCC<br>AGCAGACACCTTCTTCCCCAGCCCAGAAAGTTCCTGTGATGTCAAGCTGGTCGAG<br>AAAAGCTTTGAAACAGATACGAACCTAAACTTTCAAAACCTGTCAGTGATTGGGT<br>TCCGAATCCTCCTCCTGAAAGTGGCCGGGTTTAATCTGCTCATGACGCTGCGGCTG | TCR 10 - Alpha<br>Native<br>*Homo sapiens*<br>(nt) |
| 91 | ATGATGATATCCTTGAGAGTTTTACTGGTGATCCTGTGGCTTCAGTTAAGCTGGGT<br>TTGGAGCCAACGGAAGGAGGTGGAGCAGGATCCTGGACCCTTCAATGTTCCAGAG<br>GGAGCCACTGTCGCTTTCAACTGTACTTACAGCAACAGTGCTTCTCAGTCTTTCTT<br>CTGGTACAGACAGGATTGCAGGAAAGAACCTAAGTTGCTGATGTCCGTATACTCC<br>AGTGGTAATGAAGATGGAAGGTTTACAGCACAGCTCAATAGAGCCAGCCAGTATA<br>TTTCCCTGCTCATCAGAGACTCCAAGCTCAGTGATTCAGCCACCTACCTCTGTGTG<br>GTGAACTTCCCTTCTCGGGGTGCTGGTGGTACTAGCTATGGAAAGCTGACATTTGG<br>ACAAGGGACCATCTTGACTGTCCATCCAAATATCCAGAAGCCTGACCCTGCCGTG<br>TACCAGCTGAGAGACTCTAAATCCAGTGACAAGTCTGTCTGCCTATTCACCGATTT<br>TGATTCTCAAACAAATGTGTCACAAAGTAAGGATTCTGATGTGTATATCACAGAC<br>AAATGTGTGCTAGACATGAGGTCTATGGACTTCAAGAGCAACAGTGCTGTGGCCT<br>GGAGCAACAAATCTGACTTTGCATGTGCAAACGCCTTCAACAACAGCATTATTCC<br>AGCAGACACCTTCTTCCCCAGCCCAGAAAGTTCCTGTGATGTCAAGCTGGTCGAG<br>AAAAGCTTTGAAACAGATACGAACCTAAACTTTCAAAACCTGTCAGTGATTGGGT<br>TCCGAATCCTCCTCCTGAAAGTGGCCGGGTTTAATCTGCTCATGACGCTGCGGCTG<br>TGGTCTTCC | TCR 10 - Alpha<br>Codon-optimized/<br>cysteine-modified<br>*Homo sapiens*<br>(nt) |

SEQUENCE TABLE

| SEQ ID NO. | SEQUENCE | DESCRIPTION |
|---|---|---|
| 92 | DVKVTQSSRYLVKRTGEKVFLECVQDMDHENMFWYRQDPGLGLRLIYFSYDVKMK<br>EKGDIPEGYSVSREKKERFSLILESASTNQTSMYLCASSLSLTGNYGYTFGSGTRLTVV<br>EDLNKVFPPEVAVFEPSEAEISHTQKATLVCLATGFFPDHVELSWWVNGKEVHSGVST<br>DPQPLKEQPALNDSRYCLSSRLRVSATFWQNPRNHFRCQVQFYGLSENDEWTQDRAK<br>PVTQIVSAEAWGRADCGFTSVSYQQGVLSATILYEILLGKATLYAVLVSALVLMAMV<br>KRKDF | TCR 10 - Beta Native<br>*Homo sapiens*<br>(aa) |
| 93 | DVKVTQSSRYLVKRTGEKVFLECVQDMDHENMFWYRQDPGLGLRLIYFSYDVKMK<br>EKGDIPEGYSVSREKKERFSLILESASTNQTSMYLCASSLSLTGNYGYTFGSGTRLTVV<br>EDLNKVFPPEVAVFEPSEAEISHTQKATLVCLATGFFPDHVELSWWVNGKEVHSGVC<br>TDPQPLKEQPALNDSRYCLSSRLRVSATFWQNPRNHFRCQVQFYGLSENDEWTQDRA<br>KPVTQIVSAEAWGRADCGFTSVSYQQGVLSATILYEILLGKATLYAVLVSALVLMAM<br>VKRKDF | TCR 10 - Beta Cysteine-modified<br>*Homo sapiens*<br>(aa) |
| 94 | ATGGGAATCAGGCTCCTCTGTCGTGTGGCCTTTTGTTTCCTGGCTGTAGGCCTCGT<br>AGATGTGAAAGTAACCCAGAGCTCGAGATATCTAGTCAAAAGGACGGGAGAGAA<br>AGTTTTTCTGGAATGTGTCCAGGATATGGACCATGAAAATATGTTCTGGTATCGAC<br>AAGACCCAGGTCTGGGGCTACGGCTGATCTATTTCTCATATGATGTTAAAATGAA<br>AGAAAAAGGAGATATTCCTGAGGGGTACAGTGTCTCTAGAGAAGAAGGAGCG<br>CTTCTCCCTGATTCTGGAGTCCGCCAGCACCAACCAGACATCTATGTACCTCTGTG<br>CCAGCAGTTTATCCCTAACAGGGAACTATGGCTACACCTTCGGTTCGGGGACCAG<br>GTTAACCGTTGTAGAGGACCTGAACAAGGTGTTCCCACCCGAGGTCGCTGTGTTTG<br>AGCCATCAGAAGCAGAGATCTCCCACACCCAAAAGGCCACACTGGTGTGCCTGGC<br>CACAGGCTTCTTCCCTGACCACGTGGAGCTGAGCTGGTGGGTGAATGGGAAGGAG<br>GTGCACAGTGGGGTCAGCACGGACCCGCAGCCCCTCAAGGAGCAGCCCGCCCTCA<br>ATGACTCCAGATACTGCCTGAGCAGCCGCCTGAGGGTCTCGGCCACCTTCTGGCA<br>GAACCCCCGCAACCACTTCCGCTGTCAAGTCCAGTTCTACGGGCTCTCGGAGAAT<br>GACGAGTGGACCCAGGATAGGGCCAAACCCGTCACCCAGATCGTCAGCGCCGAG<br>GCCTGGGGTAGAGCAGACTGTGGCTTTACCTCGGTGTCCTACCAGCAAGGGGTCC<br>TGTCTGCCACCATCCTCTATGAGATCCTGCTAGGGAAGGCCACCCTGTATGCTGTG<br>CTGGTCAGCGCCCTTGTGTTGATGGCCATGGTCAAGAGAAAGGATTTC | TCR 10 - Beta Native<br>*Homo sapiens*<br>(nt) |
| 95 | ATGGGAATCAGGCTCCTCTGTCGTGTGGCCTTTTGTTTCCTGGCTGTAGGCCTCGT<br>AGATGTGAAAGTAACCCAGAGCTCGAGATATCTAGTCAAAAGGACGGGAGAGAA<br>AGTTTTTCTGGAATGTGTCCAGGATATGGACCATGAAAATATGTTCTGGTATCGAC<br>AAGACCCAGGTCTGGGGCTACGGCTGATCTATTTCTCATATGATGTTAAAATGAA<br>AGAAAAAGGAGATATTCCTGAGGGGTACAGTGTCTCTAGAGAAGAAGGAGCG<br>CTTCTCCCTGATTCTGGAGTCCGCCAGCACCAACCAGACATCTATGTACCTCTGTG<br>CCAGCAGTTTATCCCTAACAGGGAACTATGGCTACACCTTCGGTTCGGGGACCAG<br>GTTAACCGTTGTAGAGGACCTGAACAAGGTGTTCCCACCCGAGGTCGCTGTGTTTG<br>AGCCATCAGAAGCAGAGATCTCCCACACCCAAAAGGCCACACTGGTGTGCCTGGC<br>CACAGGCTTCTTCCCTGACCACGTGGAGCTGAGCTGGTGGGTGAATGGGAAGGAG<br>GTGCACAGTGGGTCTGTACGGACCCGCAGCCCCTCAAGGAGCAGCCCGCCCTCA<br>ATGACTCCAGATACTGCCTGAGCAGCCGCCTGAGGGTCTCGGCCACCTTCTGGCA<br>GAACCCCCGCAACCACTTCCGCTGTCAAGTCCAGTTCTACGGGCTCTCGGAGAAT<br>GACGAGTGGACCCAGGATAGGGCCAAACCCGTCACCCAGATCGTCAGCGCCGAG<br>GCCTGGGGTAGAGCAGACTGTGGCTTTACCTCGGTGTCCTACCAGCAAGGGGTCC<br>TGTCTGCCACCATCCTCTATGAGATCCTGCTAGGGAAGGCCACCCTGTATGCTGTG<br>CTGGTCAGCGCCCTTGTGTTGATGGCCATGGTCAAGAGAAAGGATTTC | TCR 10 - Beta Codon-optimized/cysteine-modified<br>*Homo sapiens*<br>(nt) |
| 96 | GCGGCCGCCACCATGGGAATCAGGCTCCTCTGTCGTGTGGCCTTTTGTTTCCTGGC<br>TGTAGGCCTCGTAGATGTGAAAGTAACCCAGAGCTCGAGATATCTAGTCAAAAGG<br>ACGGGAGAGAAAGTTTTTCTGGAATGTGTCCAGGATATGGACCATGAAAATATGT<br>TCTGGTATCGACAAGACCCAGGTCTGGGGCTACGGCTGATCTATTTCTCATATGAT<br>GTTAAAATGAAAGAAAAAGGAGATATTCCTGAGGGGTACAGTGTCTCTAGAGAG<br>AAGAAGGAGCGCTTCTCCCTGATTCTGGAGTCCGCCAGCACCAACCAGACATCTA<br>TGTACCTCTGTGCCAGCAGTTTATCCCTAACAGGGAACTATGGCTACACCTTCGGT<br>TCGGGGACCAGGTTAACCGTTGTAGAGGACCTGAACAAGGTGTTCCCACCCGAGG<br>TCGCTGTGTTTGAGCCATCAGAAGCAGAGATCTCCCACACCCAAAAGGCCACACT<br>GGTGTGCCTGGCCACAGGCTTCTTCCCTGACCACGTGGAGCTGAGCTGGTGGGTG<br>AATGGGAAGGAGGTGCACAGTGGGTCTGTACGGACCCGCAGCCCCTCAAGGAG<br>CAGCCCGCCCTCAATGACTCCAGATACTGCCTGAGCAGCCGCCTGAGGGTCTCGG<br>CCACCTTCTGGCAGAACCCCCGCAACCACTTCCGCTGTCAAGTCCAGTTCTACGGG<br>CTCTCGGAGAATGACGAGTGGACCCAGGATAGGGCCAAACCCGTCACCCAGATCG<br>TCAGCGCCGAGGCCTGGGGTAGAGCAGACTGTGGCTTTACCTCGGTGTCCTACCA<br>GCAAGGGGTCCTGTCTGCCACCATCCTCTATGAGATCCTGCTAGGGAAGGCCACC<br>CTGTATGCTGTGCTGGTCAGCGCCCTTGTGTTGATGGCCATGGTCAAGAGAAAGG<br>ATTTCGGATCCGGAGCTACCAACTTCTCTCTGCTGAAACAGGCAGGCGATGTGGA<br>GGAAAATCCTGGGCCAATGATGATATCCTTGAGAGTTTTACTGGTGATCCTGTGGC<br>TTCAGTTAAGCTGGGTTTGGAGCCAACGGAAGGAGGTGGAGCAGGATCCTGGACC<br>CTTCAATGTTCCAGAGGGAGCCACTGTCGCTTTCAACTGTACTTACAGCAACAGTG<br>CTTCTCAGTCTTTCTTCTGGTACAGACAGGATTGCAGGAAAGAACCTAAGTTGCTG | TCR 10 Codon-optimized/cysteine-modified full sequence<br>*Homo sapiens*<br>(nt) |

| SEQ ID NO. | SEQUENCE | DESCRIPTION |
|---|---|---|
| | ATGTCCGTATACTCCAGTGGTAATGAAGATGGAAGGTTTACAGCACAGCTCAATA<br>GAGCCAGCCAGTATATTTCCCTGCTCATCAGAGACTCCAAGCTCAGTGATTCAGCC<br>ACCTACCTCTGTGTGGTGAACTTCCCTTCTCGGGGTGCTGGTGGTACTAGCTATGG<br>AAAGCTGACATTTGGACAAGGGACCATCTTGACTGTCCATCCAAATATCCAGAAG<br>CCTGACCCTGCCGTGTACCAGCTGAGAGACTCTAAATCCAGTGACAAGTCTGTCTG<br>CCTATTCACCGATTTTGATTCTCAAACAAATGTGTCACAAAGTAAGGATTCTGATG<br>TGTATATCACAGACAAATGTGTGCTAGACATGAGGTCTATGGACTTCAAGAGCAA<br>CAGTGCTGTGGCCTGGAGCAACAAATCTGACTTTGCATGTGCAAACGCCTTCAAC<br>AACAGCATTATTCCAGCAGACACCTTCTTCCCCAGCCCAGAAAGTTCCTGTGATGT<br>CAAGCTGGTCGAGAAAGCTTTGAAACAGATACGAACCTAAACTTTCAAAACCTG<br>TCAGTGATTGGGTTCCGAATCCTCCTCCTGAAAGTGGCCGGGTTTAATCTGCTCAT<br>GACGCTGCGGCTGTGGTCTTCCTAAGGCGCGCC | |
| 97 | MGIRLLCRVAFCFLAVGLVDVKVTQSSRYLVKRTGEKVFLECVQDMDHENMFWYR<br>QDPGLGLRLIYFSYDVKMKEKGDIPEGYSVSREKKERFSLILESASTNQTSMYLCASSL<br>SLTGNYGYTFGSGTRLTVVEDLNKVFPPEVAVFEPSEAEISHTQKATLVCLATGFFPDH<br>VELSWWVNGKEVHSGVCTDPQPLKEQPALNDSRYCLSSRLRVSATFWQNPRNHFRC<br>QVQFYGLSENDEWTQDRAKPVTQIVSAEAWGRADCGFTSVSYQQGVLSATILYEILL<br>GKATLYAVLVSALVLMAMVKRKDFGSGATNFSLLKQAGDVEENPGPMMISLRVLLV<br>ILWLQLSWVWSQRKEVEQDPGPFNVPEGATVAFNCTYSNSASQSFFWYRQDCRKEPK<br>LLMSVYSSGNEDGRFTAQLNRASQYISLLIRDSKLSDSATYLCVVNFPSRGAGGTSYG<br>KLTFGQGTILTVHPNIQKPDPAVYQLRDSKSSDKSVCLFTDFDSQTNVSQSKDSDVYIT<br>DKCVLDMRSMDFKSNSAVAWSNKSDFACANAFNNSIIPADTFFPSPESSCDVKLVEKS<br>FETDTNLNFQNLSVIGFRILLLKVAGFNLLMTLRLWSS | TCR 10<br>Full sequence<br>Cysteine-<br>modified<br>Homo sapiens<br>(aa) |
| 98 | DAKTTQPNSMESNEEEPVHLPCNHSTISGTDYIHWYRQLPSQGPEYVIHGLTSNVNNR<br>MASLAIAEDRKSSTLILHRATLRDAAVYYCILSAHSNSGYALNFGKGTSLLVTPHIQNP<br>DPAVYQLRDSKSSDKSVCLFTDFDSQTNVSQSKDSDVYITDKTVLDMRSMDFKSNSA<br>VAWSNKSDFACANAFNNSIIPEDTFFPSPESSCDVKLVEKSFETDTNLNFQNLSVIGFRI<br>LLLKVAGFNLLMTLRLWSS | TCR 11 - Alpha<br>Native<br>Homo sapiens<br>(aa) |
| 99 | DAKTTQPNSMESNEEEPVHLPCNHSTISGTDYIHWYRQLPSQGPEYVIHGLTSNVNNR<br>MASLAIAEDRKSSTLILHRATLRDAAVYYCILSAHSNSGYALNFGKGTSLLVTPHIQNP<br>DPAVYQLRDSKSSDKSVCLFTDFDSQTNVSQSKDSDVYITDKCVLDMRSMDFKSNSA<br>VAWSNKSDFACANAFNNSIIPEDTFFPSPESSCDVKLVEKSFETDTNLNFQNLSVIGFRI<br>LLLKVAGFNLLMTLRLWSS | TCR 11 - Alpha<br>Cysteine-<br>modified<br>Homo sapiens<br>(aa) |
| 100 | ATGAAGTTGGTGACAAGCATTACTGTACTCCTATCTTTGGGTATTATGGGTGATGC<br>TAAGACCACACAGCCAAATTCAATGGAGAGTAACGAAGAAGAGCCTGTTCACTTG<br>CCTTGTAACCACTCCACAATCAGTGGAACTGATTACATACATTGGTATCGACAGCT<br>TCCCTCCCAGGGTCCAGAGTACGTGATTCATGGTCTTACAAGCAATGTGAACAAC<br>AGAATGGCCTCTCTGGCAATCGCTGAAGACAGAAAGTCCAGTACCTTGATCCTGC<br>ACCGTGCTACCTTGAGAGATGCTGCTGTGTACTACTGCATCCTGAGCGCTCACTCA<br>AATTCCGGGTATGCACTCAACTTCGGCAAAGGCACCTCGCTGTTGGTCACACCCCA<br>TATCCAGAACCCTGACCCTGCCGTGTACCAGCTGAGAGACTCTAAATCCAGTGAC<br>AAGTCTGTCTGCCTATTCACCGATTTTGATTCTCAAACAAATGTGTCACAAAGTAA<br>GGATTCTGATGTGTATATCACAGACAAATGTGTCTAGACATGAGGTCTATGGAC<br>TTCAAGAGCAACAGTGCTGTGGCCTGGAGCAACAAATCTGACTTTGCATGTGCAA<br>ACGCCTTCAACAACAGCATTATTCCAGAAGACACCTTCTTCCCCAGCCCAGAAAG<br>TTCCTGTGATGTCAAGCTGGTCGAGAAAGCTTTGAAACAGATACGAACCTAAAC<br>TTTCAAAACCTGTCAGTGATTGGGTTCCGAATCCTCCTCCTGAAAGTGGCCGGGTT<br>TAATCTGCTCATGACGCTGCGGCTG | TCR 11 - Alpha<br>Native<br>Homo sapiens<br>(nt) |
| 101 | ATGAAGTTGGTGACAAGCATTACTGTACTCCTATCTTTGGGTATTATGGGTGATGC<br>TAAGACCACACAGCCAAATTCAATGGAGAGTAACGAAGAAGAGCCTGTTCACTTG<br>CCTTGTAACCACTCCACAATCAGTGGAACTGATTACATACATTGGTATCGACAGCT<br>TCCCTCCCAGGGTCCAGAGTACGTGATTCATGGTCTTACAAGCAATGTGAACAAC<br>AGAATGGCCTCTCTGGCAATCGCTGAAGACAGAAAGTCCAGTACCTTGATCCTGC<br>ACCGTGCTACCTTGAGAGATGCTGCTGTGTACTACTGCATCCTGAGCGCTCACTCA<br>AATTCCGGGTATGCACTCAACTTCGGCAAAGGCACCTCGCTGTTGGTCACACCCCA<br>TATCCAGAACCCTGACCCTGCCGTGTACCAGCTGAGAGACTCTAAATCCAGTGAC<br>AAGTCTGTCTGCCTATTCACCGATTTTGATTCTCAAACAAATGTGTCACAAAGTAA<br>GGATTCTGATGTGTATATCACAGACAAATGTGTGCTAGACATGAGGTCTATGGAC<br>TTCAAGAGCAACAGTGCTGTGGCCTGGAGCAACAAATCTGACTTTGCATGTGCAA<br>ACGCCTTCAACAACAGCATTATTCCAGAAGACACCTTCTTCCCCAGCCCAGAAAG<br>TTCCTGTGATGTCAAGCTGGTCGAGAAAGCTTTGAAACAGATACGAACCTAAAC<br>TTTCAAAACCTGTCAGTGATTGGGTTCCGAATCCTCCTCCTGAAAGTGGCCGGGTT<br>TAATCTGCTCATGACGCTGCGGCTGTGGTCTTCC | TCR 11 - Alpha<br>Codon-optimized/<br>cysteine-modified<br>Homo sapiens<br>(nt) |

| SEQ ID NO. | SEQUENCE | DESCRIPTION |
|---|---|---|
| 102 | SAVISQKPSRDICQRGTSLTIQCQVDSQVTMMFWYRQQPGQSLTLIATANQGSEATYE SGFVIDKFPISRPNLTFSTLTVSNMSPEDSSIYLCSVVPWTRGGSTDTQYFGPGTRLTVL EDLKNVFPPEVAVFEPSEAEISHTQKATLVCLATGFYPDHVELSWWVNGKEVHSGVS TDPQPLKEQPALNDSRYCLSSRLRVSATFWQNPRNHFRCQVQFYGLSENDEWTQDRA KPVTQIVSAEAWGRADCGFTSESYQQGVLSATILYEILLGKATLYAVLVSALVLMAM VKRKDSRG | TCR 11 - Beta Native Homo sapiens (aa) |
| 103 | SAVISQKPSRDICQRGTSLTIQCQVDSQVTMMFWYRQQPGQSLTLIATANQGSEATYE SGFVIDKFPISRPNLTFSTLTVSNMSPEDSSIYLCSVVPWTRGGSTDTQYFGPGTRLTVL EDLKNVFPPEVAVFEPSEAEISHTQKATLVCLATGFYPDHVELSWWVNGKEVHSGVC TDPQPLKEQPALNDSRYCLSSRLRVSATFWQNPRNHFRCQVQFYGLSENDEWTQDRA KPVTQIVSAEAWGRADCGFTSESYQQGVLSATILYEILLGKATLYAVLVSALVLMAM VKRKDSRG | TCR 11 - Beta Cysteine-modified Homo sapiens (aa) |
| 104 | ATGCTGAGTCTTCTGCTCCTTCTCCTGGGACTAGGCTCTGTGTTCAGTGCTGTCATC TCTCAAAAGCCAAGCAGGGATATCTGTCAACGTGGAACCTCCCTGACGATCCAGT GTCAAGTCGATAGCCAAGTCACCATGATGTTCTGGTACCGTCAGCAACCTGGACA GAGCCTGACACTGATCGCAACTGCAAATCAGGGCTCTGAGGCCACATATGAGAGT GGATTTGTCATTGACAAGTTTCCCATCAGCCGCCCAAACCTAACATTCTCAACTCT GACTGTGAGCAACATGAGCCCTGAAGCAGCAGCATATATCTCTGCAGCGTTGTC CCTTGGACGCGCGGGGGGAGCACAGATACGCAGTATTTTGGCCCAGGCACCCGGC TGACAGTGCTCGAGGACCTGAAAAACGTGTTCCCACCCGAGGTCGCTGTGTTTGA GCCATCAGAAGCAGAGATCTCCCACACCCAAAAGGCCACACTGGTGTGCCTGGCC ACAGGCTTCTACCCCGACCACGTGGAGCTGAGCTGGTGGGTGAATGGGAAGGAGG TGCACAGTGGGGTCAGCACAGACCCGCAGCCCCTCAAGGAGCAGCCCGCCCTCAA TGACTCCAGATACTGCCTGAGCAGCCGCCTGAGGGTCTCGGCCACCTTCTGGCAG AACCCCCGCAACCACTTCCGCTGTCAAGTCCAGTTCTACGGGCTCTCGGAGAATG ACGAGTGGACCCAGGATAGGGCCAAACCTGTCACCCAGATCGTCAGCGCCGAGGC CTGGGGTAGAGCAGACTGTGGCTTCACCTCCGAGTCTTACCAGCAAGGGGTCCTG TCTGCCACCATCCTCTATGAGATCTTGCTAGGGAAGGCCACCTTGTATGCCGTGCT GGTCAGTGCCCTCGTGCTGATGGCCATGGTCAAGAGAAAGGATTCCAGAGGC | TCR 11 - Beta Native Homo sapiens (nt) |
| 105 | ATGCTGAGTCTTCTGCTCCTTCTCCTGGGACTAGGCTCTGTGTTCAGTGCTGTCATC TCTCAAAAGCCAAGCAGGGATATCTGTCAACGTGGAACCTCCCTGACGATCCAGT GTCAAGTCGATAGCCAAGTCACCATGATGTTCTGGTACCGTCAGCAACCTGGACA GAGCCTGACACTGATCGCAACTGCAAATCAGGGCTCTGAGGCCACATATGAGAGT GGATTTGTCATTGACAAGTTTCCCATCAGCCGCCCAAACCTAACATTCTCAACTCT GACTGTGAGCAACATGAGCCCTGAAGCAGCAGCATATATCTCTGCAGCGTTGTC CCTTGGACGCGCGGGGGGAGCACAGATACGCAGTATTTTGGCCCAGGCACCCGGC TGACAGTGCTCGAGGACCTGAAAAACGTGTTCCCACCCGAGGTCGCTGTGTTTGA GCCATCAGAAGCAGAGATCTCCCACACCCAAAAGGCCACACTGGTGTGCCTGGCC ACAGGCTTCTACCCCGACCACGTGGAGCTGAGCTGGTGGGTGAATGGGAAGGAGG TGCACAGTGGGGTCTGTACAGACCCGCAGCCCCTCAAGGAGCAGCCCGCCCTCAA TGACTCCAGATACTGCCTGAGCAGCCGCCTGAGGGTCTCGGCCACCTTCTGGCAG AACCCCCGCAACCACTTCCGCTGTCAAGTCCAGTTCTACGGGCTCTCGGAGAATG ACGAGTGGACCCAGGATAGGGCCAAACCTGTCACCCAGATCGTCAGCGCCGAGGC CTGGGGTAGAGCAGACTGTGGCTTCACCTCCGAGTCTTACCAGCAAGGGGTCCTG TCTGCCACCATCCTCTATGAGATCTTGCTAGGGAAGGCCACCTTGTATGCCGTGCT GGTCAGTGCCCTCGTGCTGATGGCCATGGTCAAGAGAAAGGATTCCAGAGGC | TCR 11 - Beta Codon-optimized/cysteine-modified Homo sapiens (nt) |
| 106 | GCGGCCGCCACCATGCTGAGTCTTCTGCTCCTTCTCCTGGGACTAGGCTCTGTGTT CAGTGCTGTCATCTCTCAAAAGCCAAGCAGGGATATCTGTCAACGTGGAACCTCC CTGACGATCCAGTGTCAAGTCGATAGCCAAGTCACCATGATGTTCTGGTACCGTCA GCAACCTGGACAGAGCCTGACACTGATCGCAACTGCAAATCAGGGCTCTGAGGCC ACATATGAGAGTGGATTTGTCATTGACAAGTTTCCCATCAGCCGCCCAAACCTAAC ATTCTCAACTCTGACTGTGAGCAACATGAGCCCTGAAGACAGCAGCATATATCTCT GCAGCGTTGTCCCTTGGACGCGCGGGGGGAGCACAGATACGCAGTATTTTGGCCC AGGCACCCGGCTGACAGTGCTCGAGGACCTGAAAAACGTGTTCCCACCCGAGGTC GCTGTGTTTGAGCCATCAGAAGCAGAGATCTCCCACACCCAAAAGGCCACACTGG TGTGCCTGGCCACAGGCTTCTACCCCGACCACGTGGAGCTGAGCTGGTGGGTGAA TGGGAAGGAGGTGCACAGTGGGGTCTGTACAGACCCGCAGCCCCTCAAGGAGCA GCCCGCCCTCAATGACTCCAGATACTGCCTGAGCAGCCGCCTGAGGGTCTCGGCC ACCTTCTGGCAGAACCCCCGCAACCACTTCCGCTGTCAAGTCCAGTTCTACGGGCT CTCGGAGAATGACGAGTGGACCCAGGATAGGGCCAAACCTGTCACCCAGATCGTC AGCGCCGAGGCCTGGGGTAGAGCAGACTGTGGCTTCACCTCCGAGTCTTACCAGC AAGGGGTCCTGTCTGCCACCATCCTCTATGAGATCTTGCTAGGGAAGGCCACCTTG TATGCCGTGCTGGTCAGTGCCCTCGTGCTGATGGCCATGGTCAAGAGAAAGGATT CCAGAGGCGGATCCGGAGCTACCAACTTCTCTCTGCTGAAACAGGCAGGCGATGT GGAGGAAAATCCTGGGCCAATGAAGTTGGTGACAAGCATTACTGTACTCCTATCT TTGGGTATTATGGGTGATGCTAAGACCACACAGCCAAATTCAATGGAGAGTAACG AAGAAGAGCCTGTTCACTTGCCTTGTAACCACTCCACAATCAGTGGAACTGATTAC ATACATTGGTATCGACAGCTTCCCTCCCAGGGTCCAGAGTACGTGATTCATGGTCT | TCR 11 Codon-optimized/cysteine-modified full sequence Homo sapiens (nt) |

| SEQ ID NO. | SEQUENCE | DESCRIPTION |
|---|---|---|
| | TACAAGCAATGTGAACAACAGAATGGCCTCTCTGGCAATCGCTGAAGACAGAAAG<br>TCCAGTACCTTGATCCTGCACCGTGCTACCTTGAGAGATGCTGCTGTGTACTACTG<br>CATCCTGAGCGCTCACTCAAATTCCGGGTATGCACTCAACTTCGGCAAAGGCACCT<br>CGCTGTTGGTCACACCCCATATCCAGAACCCTGACCCTGCCGTGTACCAGCTGAGA<br>GACTCTAAATCCAGTGACAAGTCTGTCTGCCTATTCACCGATTTTGATTCTCAAAC<br>AAATGTGTCACAAAGTAAGGATTCTGATGTGTATATCACAGACAAATGTGTGCTA<br>GACATGAGGTCTATGGACTTCAAGAGCAACAGTGCTGTGTGGCCTGGAGCAACAAAT<br>CTGACTTTGCATGTGCAAACGCCTTCAACAACAGCATTATTCCAGAAGACACCTTC<br>TTCCCCAGCCCAGAAAGTTCCTGTGATGTCAAGCTGGTCGAGAAAAGCTTTGAAA<br>CAGATACGAACCTAAACTTTCAAAACCTGTCAGTGATTGGGTTCCGAATCCTCCTC<br>CTGAAAGTGGCCGGGTTTAATCTGCTCATGACGCTGCGGCTGTGGTCTTCCTAAGG<br>CGCGCC | |
| 107 | MLSLLLLLLGLGSVFSAVISQKPSRDICQRGTSLTIQCQVDSQVTMMFWYRQQPGQSL<br>TLIATANQGSEATYESGFVIDKFPISRPNLTFSTLTVSNMSPEDSSIYLCSVVPWTRGGS<br>TDTQYFGPGTRLTVLEDLKNVFPPEVAVFEPSEAEISHTQKATLVCLATGFYPDHVELS<br>WWVNGKEVHSGVCTDPQPLKEQPALNDSRYCLSSRLRVSATFWQNPRNHFRCQVQF<br>YGLSENDEWTQDRAKPVTQIVSAEAWGRADCGFTSESYQQGVLSATILYEILLGKATL<br>YAVLVSALVLMAMVKRKDSRGGSGATNFSLLKQAGDVEENPGPMKLVTSITVLLSL<br>GIMGDAKTTQPNSMESNEEEPVHLPCNHSTISGTDYIHWYRQLPSQGPEYVIHGLTSN<br>VNNRMASLAIAEDRKSSTLILHRATLRDAAVYYCILSAHSNSGYALNFGKGTSLLVTP<br>HIQNPDPAVYQLRDSKSSDKSVCLFTDFDSQTNVSQSKDSDVYITDKCVLDMRSMDF<br>KSNSAVAWSNKSDFACANAFNNSIIPEDTFFPSPESSCDVKLVEKSFETDTNLNFQNLS<br>VIGFRILLLKVAGFNLLMTLRLWSS | TCR 11<br>Full sequence<br>Cysteine-<br>modified<br>Homo sapiens<br>(aa) |
| 108 | ATGGATACCTGGCTCGTATGCTGGGCAATTTTTAGTCTCTTGAAAGCAGGACTCAC<br>AGAACCTGAAGTCACCCAGACTCCCAGCCATCAGGTCACACAGATGGGACAGGA<br>AGTGATCTTGCGCTGTGTCCCCATCTCTAATCACTTATACTTCTATTGGTACAGAC<br>AAATCTTGGGGCAGAAAGTCGAGTTTCTGGTTTCCTTTTATAATAATGAAATCTCA<br>GAGAAGTCTGAAATATTCGATGATCAATTCTCAGTTGAAAGGCCTGATGGATCAA<br>ATTTCACTCTGAAGATCCGGTCCACAAAGCTGGAGGACTCAGCCATGTACTTCTGT<br>GCCAGCACAACGAGGAGCTCCTACGAGCAGTACTTCGGGCCGGGCACCAGGCTCA<br>CGGTCACAGAGGACCTGAAAAACGTGTTCCCACCCGAGGTCGCTGTGTTTGAGCC<br>ATCAGAAGCAGAGATCTCCCACACCCAAAAGGCCACACTGGTATGCCTGGCCACA<br>GGCTTCTACCCCGACCACGTGGAGCTGAGCTGGTGGGTGAATGGGAAGGAGGTGC<br>ACAGTGGGGTCAGCACAGACCCGCAGCCCCTCAAGGAGCAGCCCGCCCTCAATGA<br>CTCCAGATACTGCCTGAGCAGCCGCCTGAGGGTCTCGGCCACCTTCTGGCAGAAC<br>CCCCGCAACCACTTCCGCTGTCAAGTCCAGTTCTACGGGCTCTCGGAGAATGACG<br>AGTGGACCCAGGATAGGGCCAAACCTGTCACCCAGATCGTCAGCGCCGAGGCCTG<br>GGGTAGAGCAGACTGTGGCTTCACCTCCGAGTCTTACCAGCAAGGGGTCCTGTCT<br>GCCACCATCCTCTATGAGATCTTGCTAGGGAAGGCCACCTTGTATGCCGTGCTGGT<br>CAGTGCCCTCGTGCTGATGGCCATGGTCAAGAGAAAGGATTCCAGAGGCTAG | TCR 12 - Beta<br>Native<br>Homo sapiens<br>(nt) |
| 109 | DLRNVTPPKVSLFEPSKAEIANKQKATLVCLARGFFPDHVELSWWVNGKEVHSGVST<br>DPQAYKESNYSYCLSSRLRVSATFWHNPRNHFRCQVQFHGLSEEDKWPEGSPKPVTQ<br>NISAEAWGRADCGITSASYHQGVLSATILYEILLGKATLYAVLVSGLVLMAMVKRKN<br>S | Mouse beta<br>constant sequence<br>Mus musculus<br>(aa) |
| 110 | MGIRLLCRVAFCFLAVGLVDVKVTQSSRYLVKRTGEKVFLECVQDMDHENMFWYR<br>QDPGLGLRLIYFSYDVKMKEKGDIPEGYSVSREKKERFSLILESASTNQTSMYLCASSL<br>WGASTDTQYFGPGTRLTVLEDLKNVFPPEVAVFEPSEAEISHTQKATLVCLATGFYPD<br>HVELSWWVNGKEVHSGVSTDPQPLKEQPALNDSRYCLSSRLRVSATFWQNPRNHFR<br>CQVQFYGLSENDEWTQDRAKPVTQIVSAEAWGRADCGFTSESYQQGVLSATILYEILL<br>GKATLYAVLVSALVLMAMVKRKDSRG | TCR 8 - Beta<br>Native<br>Homo sapiens<br>(aa) |
| 111 | AQKITQTQPGMFVQEKEAVTLDCTYDTSDQSYGLFWYKQPSSGEMIFLIYQGSYDEQ<br>NATEGRYSLNFQKARKSANLVISASQLGDSAMYFCAMREGRGFKTIFGAGTRLFVKA | TCR 3<br>alpha variable<br>region<br>Homo sapiens<br>(aa) |
| 112 | GAGVSQSPRYKVAKRGQDVALRCDPISGHVSLFWYQQALGQGPEFLTYFQNEAQLD<br>KSGLPSDRFFAERPEGSVSTLKIQRTQQEDSAVYLCASSHLAGFTGELFFGEGSRLTVL | TCR 3<br>beta variable<br>region<br>Homo sapiens<br>(aa) |
| 113 | DAKTTQPNSMESNEEEPVHLPCNHSTISGTDYIHWYRQLPSQGPEYVIHGLTSNVNNR<br>MASLAIAEDRKSSTLILHRATLRDAAVYYCILLVIRGTSYGKLTFGQGTILTVHP | TCR 4 - (E6)29<br>alpha variable<br>region<br>Homo sapiens<br>(aa) |

SEQUENCE TABLE

| SEQ ID NO. | SEQUENCE | DESCRIPTION |
|---|---|---|
| 114 | GVSQDPRHKITKRGQNVTFRCDPISEHNRLYWYRQTLGQGPEFLTYFQNEAQLEKSRL LSDRFSAERPKGSFSTLEIQRTEQGDSAMYLCASSPGGGNTEAFFGQGTRLTVV | TCR 4 - (E6)29 Beta variable region Homo sapiens (aa) |
| 115 | AQKITQTQPGMFVQEKEAVTLDCTYDTSDQSYGLFWYKQPSSGEMIFLIYQGSYDEQ NATEGRYSLNFQKARKSANLVISASQLGDSAMYFCAMREGTGTSYGKLTFGQGTILT VHP | TCR 5 - (E6)29 - TCR alpha variable region Homo sapiens (aa) |
| 116 | KVTQSSRYLVKRTGEKVFLECVQDMDHENMFWYRQDPGLGLRLIYFSYDVKMKEK GDIPEGYSVSREKKERFSLILESASTNQTSMYLCASSPWGETHQPQHFGDGTRLSIL | TCR 5 - (E6)29 - TCR beta variable region Homo sapiens (aa) |
| 117 | GEDVEQSLFLSVREGDSSVINCTYTDSSSTYLYWYKQEPGAGLQLLTYIFSNMDMKQ DQRLTVLLNKKDKHLSLRIADTQTGDSAIYFCAESIRGFGNVLHCGSGTQVIVLP | TCR 6 alpha variable region Homo sapiens (aa) |
| 118 | EPEVTQTPSHQVTQMGQEVILRCVPISNHLYFYWYRQILGQKVEFLVSFYNNEISEKSE IFDDQFSVERPDGSNFTLKIRSTKLEDSAMYFCASTTRSSYEQYFGPGTRLTVT | TCR 6, TCR 12 Beta variable region Homo sapiens (aa) |
| 119 | KNQVEQSPQSLIILEGKNCTLQCNYTVSPFSNLRWYKQDTGRGPVSLTIMTFSENTKSN GRYTATLDADTKQSSLHITASQLSDSASYICVVSRDNYGQNFVFGPGTRLSVLP | TCR 7/TCR 54 - (E7)11 - alpha variable region Homo sapiens (aa) |
| 120 | EPEVTQTPSHQVTQMGQEVILRCVPISNHLYFYWYRQILGQKVEFLVSFYNNEISEKSE IFDDQFSVERPDGSNFTLKIRSTKLEDSAMYFCAITDRTNYGYTFGSGTRLTVV | TCR 7/TCR 54- (E7)11 -Beta variable region Homo sapiens (aa) |
| 121 | KQEVTQIPAALSVPEGENLVLNCSFTDSAIYNLQWFRQDPGKGLTSLLLIQSSQREQTS GRLNASLDKSSGRSTLYIAASQPGDSATYLCAVRPLGNTPLVFGKGTRLSVIA | TCR 8 alpha variable region Homo sapiens (aa) |
| 122 | KVTQSSRYLVKRTGEKVFLECVQDMDHENMFWYRQDPGLGLRLIYFSYDVKMKEK GDIPEGYSVSREKKERFSLILESASTNQTSMYLCASSLWGASTDTQYFGPGTRLTVL | TCR 8 Beta variable region Homo sapiens (aa) |
| 123 | AQKITQTQPGMFVQEKEAVTLDCTYDTSDPSYGLFWYKQPSSGEMIFLIYQGSYDQQ NATEGRYSLNFQKARKSANLVISASQLGDSAMYFCAMRTAGGTSYGKLTFGQGTILT VHP | TCR 9 alpha variable region Homo sapiens (aa) |
| 124 | NAGVTQTPKFRVLKTGQSMTLLCAQDMNHEYMYWYRQDPGMGLRLIHYSVGEGTT AKGEVPDGYNVSRLKKQNFLLGLESAAPSQTSVYFCASSYFGTAYEQYFGPGTRLTV T | TCR 9 Beta variable region Homo sapiens (aa) |
| 125 | RKEVEQDPGPFNVPEGATVAFNCTYSNSASQSFFWYRQDCRKEPKLLMSVYSSGNED GRFTAQLNRASQYISLLIRDSKLSDSATYLCVVNFPSRGAGGTSYGKLTFGQGTILTVH P | TCR 10 alpha variable region Homo sapiens (aa) |

SEQUENCE TABLE

| SEQ ID NO. | SEQUENCE | DESCRIPTION |
|---|---|---|
| 126 | KVTQSSRYLVKRTGEKVFLECVQDMDHENMFWYRQDPGLGLRLIYFSYDVKMKEK GDIPEGYSVSREKKERFSLILESASTNQTSMYLCASSLSLTGNYGYTFGSGTRLTVV | TCR 10 Beta variable region *Homo sapiens* (aa) |
| 127 | DAKTTQPNSMESNEEEPVHLPCNHSTISGTDYIHWYRQLPSQGPEYVIHGLTSNVNNR MASLAIAEDRKSSTLILHRATLRDAAVYYCILSAHSNSGYALNFGKGTSLLVTP | TCR 11 alpha variable region *Homo sapiens* (aa) |
| 128 | SAVISQKPSRDICQRGTSLTIQCQVDSQVTMMFWYRQQPGQSLTLIATANQGSEATYE SGFVIDKFPISRPNLTFSTLTVSNMSPEDSSIYLCSVVPWTRGGSTDTQYFGPGTRLTVL | TCR 11 Beta variable region *Homo sapiens* (aa) |
| 129 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASSL WGASTDTQYFGPGTRLTVEDLKNVFPPEVAVFEPSEAEISHTQKATLVCLATGFYPD HVELSWWVNGKEVHSGVCTDPQPLKEQPALNDSRYCLSSRLRVSATFWQNPRNHFR CQVQFYGLSENDEWTQDRAKPVTQIVSAEAWGRADCGFTSESYQQGVLSATILYEILL GKATLYAVLVSALVLMAMVKRKDSRG | TCR 8 - Beta Cysteine-modified *Homo sapiens* (aa) |
| 130 | MSLSSLLKVVTASLWLGPGIAQKITQTQPGMFVQEKEAVTLDCTYDTSDPSYGLFWY KQPSSGEMIFLIYQGSYDQQNATEGRYSLNFQKARKSANLVISASQLGDSAMYFCAM RTAGGTSYGKLTFGQGTILTVHPNIQNPDPAVYQLRDSKSSDKSVCLFTDFDSQTNVS QSKDSDVYITDKTVLDMRSMDFKSNSAVAWSNKSDFACANAFNNSIIPEDTFFPSPESS CDVKLVEKSFETDTNLNFQNLSVIGFRILLLKVAGFNLLMTLRLWSS | TCR 9 - Alpha Native *Homo sapiens* (aa) |
| 131 | MSLSSLLKVVTASLWLGPGIAQKITQTQPGMFVQEKEAVTLDCTYDTSDPSYGLFWY KQPSSGEMIFLIYQGSYDQQNATEGRYSLNFQKARKSANLVISASQLGDSAMYFCAM RTAGGTSYGKLTFGQGTILTVHPNIQNPDPAVYQLRDSKSSDKSVCLFTDFDSQTNVS QSKDSDVYITDKCVLDMRSMDFKSNSAVAWSNKSDFACANAFNNSIIPEDTFFPSPES SCDVKLVEKSFETDTNLNFQNLSVIGFRILLLLKVAGFNLLMTLRLWSS | TCR 9 - Alpha Cysteine-modified *Homo sapiens* (aa) |
| 132 | MSLGLLCCGAFSLLWAGPVNAGVTQTPKFRVLKTGQSMTLLCAQDMNHEYMYWYR QDPGMGLRLIHYSVGEGTTAKGEVPDGYNVSRLKKQNFLLGLESAAPSQTSVYFCAS SYFGTAYEQYFGPGTRLTVTEDLKNVFPPEVAVFEPSEAEISHTQKATLVCLATGFYPD HVELSWWVNGKEVHSGVSTDPQPLKEQPALNDSRYCLSSRLRVSATFWQNPRNHFR CQVQFYGLSENDEWTQDRAKPVTQIVSAEAWGRADCGFTSESYQQGVLSATILYEILL GKATLYAVLVSALVLMAMVKRKDSRG | TCR 9 - Beta Native *Homo sapiens* (aa) |
| 133 | MSLGLLCCGAFSLLWAGPVNAGVTQTPKFRVLKTGQSMTLLCAQDMNHEYMYWYR QDPGMGLRLIHYSVGEGTTAKGEVPDGYNVSRLKKQNFLLGLESAAPSQTSVYFCAS SYFGTAYEQYFGPGTRLTVTEDLKNVFPPEVAVFEPSEAEISHTQKATLVCLATGFYPD HVELSWWVNGKEVHSGVCTDPQPLKEQPALNDSRYCLSSRLRVSATFWQNPRNHFR CQVQFYGLSENDEWTQDRAKPVTQIVSAEAWGRADCGFTSESYQQGVLSATILYEILL GKATLYAVLVSALVLMAMVKRKDSRG | TCR 9 - Beta Cysteine-modified *Homo sapiens* (aa) |
| 134 | MMISLRVLLVILWLQLSWVWSQRKEVEQDPGPFNVPEGATVAFNCTYSNSASQSFFW YRQDCRKEPKLLMSVYSSGNEDGRFTAQLNRASQYISLLIRDSKLSDSATYLCVVNFP SRGAGGTSYGKLTFGQGTILTVHPNIQKPDPAVYQLRDSKSSDKSVCLFTDFDSQTNV SQSKDSDVYITDKTVLDMRSMDFKSNSAVAWSNKSDFACANAFNNSIIPADTFFPSPE SSCDVKLVEKSFETDTNLNFQNLSVIGFRILLLKVAGFNLLMTLRLWSS | TCR 10 - Alpha Native *Homo sapiens* (aa) |
| 135 | MMISLRVLLVILWLQLSWVWSQRKEVEQDPGPFNVPEGATVAFNCTYSNSASQSFFW YRQDCRKEPKLLMSVYSSGNEDGRFTAQLNRASQYISLLIRDSKLSDSATYLCVVNFP SRGAGGTSYGKLTFGQGTILTVHPNIQKPDPAVYQLRDSKSSDKSVCLFTDFDSQTNV SQSKDSDVYITDKCVLDMRSMDFKSNSAVAWSNKSDFACANAFNNSIIPADTFFPSPE SSCDVKLVEKSFETDTNLNFQNLSVIGFRILLLKVAGFNLLMTLRLWSS | TCR 10 - Alpha Cysteine-modified *Homo sapiens* (aa) |
| 136 | TSDQSYG | TCR 3/TCR 5/ TCR 15/TCR 19/ TCR 21/TCR 23/ TCR 24/TCR 25/ TCR 26/TCR 29 - (E6)29 - TCR alpha CDR1 *Homo sapiens* (aa) |

-continued

| SEQ ID NO. | SEQUENCE | DESCRIPTION |
| --- | --- | --- |
| 137 | QGSYDEQN | TCR 3/TCR 5/ TCR 15/TCR 19/ TCR 21/TCR 23/ TCR 25/TCR 26/TCR 29 - (E6)29/- TCR alpha CDR2 *Homo sapiens* (aa) |
| 138 | AMREGRGFKTI | TCR 3 alpha CDR3 *Homo sapiens* (aa) |
| 139 | SGHVS | TCR 3/TCR 13/ TCR 37/TCR 53 Beta CDR1 *Homo sapiens* (aa) |
| 140 | FQNEAQ | TCR 3/TCR 4/ TCR 13/TCR 37- (E6)29Beta CDR2 *Homo sapiens* (aa) |
| 141 | ASSHLAGFTGELF | TCR 3 Beta CDR3 *Homo sapiens* (aa) |
| 142 | TISGTDY | TCR 4/TCR 27 - (E6)29/ TCR 11 alpha CDR1 *Homo sapiens* (aa) |
| 143 | GLTSN | TCR 4/TCR 27 - (E6)29/ TCR 11 alpha CDR2 *Homo sapiens* (aa) |
| 144 | ILLVIRGTSYGKLT | TCR 4 - (E6)29 alpha CDR3 *Homo sapiens* (aa) |
| 145 | SEHNR | TCR 4 - (E6)29 Beta CDR1 *Homo sapiens* (aa) |
| 146 | ASSPGGGNTEAF | TCR 4 - (E6)29 Beta CDR3 *Homo sapiens* (aa) |
| 147 | AMREGTGTSYGKLT | TCR 5 - (E6)29 - TCR alpha CDR3 *Homo sapiens* (aa) |

-continued

| SEQ ID NO. | SEQUENCE | DESCRIPTION |
|---|---|---|
| 148 | MDHEN | TCR 5/TCR 16/ TCR 17/TCR 18/ TCR 19/TCR 23/ TCR 24/TCR 25/ TCR 28 - (E6)29/TCR 8/ TCR 10/TCR 14 - TCR beta CDR1 Homo sapiens (aa) |
| 149 | SYDVKM | TCR 5/TCR 16/ TCR 17/TCR 18/ TCR 19/TCR 23/ TCR 24/TCR 25/ TCR 28 - (E6)29/ TCR 8/TCR 10/ TCR 14 - TCR beta CDR2 Homo sapiens (aa) |
| 150 | ASSPWGETHQPQH | TCR 5 - (E6)29 TCR beta CDR3 Homo sapiens (aa) |
| 151 | DSSSTY | TCR 6, TCR 12, TCR 50, TCR 55 alpha CDR1 Homo sapiens (aa) |
| 152 | IFSNMDM | TCR 6, TCR 12, TCR 50, TCR 55 alpha CDR2 Homo sapiens (aa) |
| 153 | AESIRGFGNVLH | TCR 6 alpha CDR3 Homo sapiens (aa) |
| 154 | SNHLY | TCR 6/TCR 7 - (E7)11, E7(11-19)/ TCR 12 consensus, TCR 30/TCR 33/TCR 36/TCR 39/TCR 40/TCR 41/TCR 42/TCR 43/TCR 47/TCR 48/TCR 49/TCR 51/TCR 54/TCR 55/TCR 66 Beta CDR1 Homo sapiens (aa) |
| 155 | FYNNEI | TCR 6/TCR 7 - (E7)11, E7(11-19)/ TCR 12 consensus, TCR 30/TCR 33/TCR 36/TCR 39/TCR 42/TCR 43/ TCR 47/TCR 48/ TCR 49/TCR 51/ TCR 54/TCR 55/ |

-continued

| SEQ ID NO. | SEQUENCE | DESCRIPTION |
|---|---|---|
| | | TCR 66 Beta CDR2 *Homo sapiens* (aa) |
| 156 | ASTTRSSYEQY | TCR 6/TCR 12/ TCR 55 Beta CDR3 *Homo sapiens* (aa) |
| 157 | VSPFSN | TCR 7/TCR 54 alpha CDR1 *Homo sapiens* (aa) |
| 158 | MTFSENT | TCR 7/TCR 54 - (E7)11 - alpha CDR2 *Homo sapiens* |
| 159 | VVSRDNYGQNFV | TCR 7/TCR 54 - (E7)11 - alpha CDR3 *Homo sapiens* (aa) |
| 160 | AITDRTNYGYT | TCR 7/TCR 54- (E7)11 -Beta CDR3 *Homo sapiens* (aa) |
| 161 | DSAIYN | TCR 8/TCR 16/ TCR 18 alpha CDR1 *Homo sapiens* (aa) |
| 162 | IQSSQRE | TCR 8/TCR 16/ TCR 18 alpha CDR2 *Homo sapiens* |
| 163 | AVRPLGNTPLV | TCR 8 alpha CDR3 *Homo sapiens* |
| 164 | ASSLWGASTDTQY | TCR 8 Beta CDR3 *Homo sapiens* (aa) |
| 165 | TSDPSYG | TCR 9/TCR 17 alpha CDR1 *Homo sapiens* (aa) |
| 166 | QGSYDQQN | TCR 9/TCR 17 alpha CDR2 *Homo sapiens* (aa) |
| 167 | AMRTAGGTSYGKLT | TCR 9 alpha CDR3 *Homo sapiens* (aa) |
| 168 | MNHEY | TCR 9/TCR 26 Beta CDR1 *Homo sapiens* (aa) |

| SEQ ID NO. | SEQUENCE | DESCRIPTION |
| --- | --- | --- |
| 169 | SVGEGT | TCR 9/TCR 26 Beta CDR2 Homo sapiens (aa) |
| 170 | ASSYFGTAYEQY | TCR 9 Beta CDR3 Homo sapiens (aa) |
| 171 | NSASQS | TCR 10/TCR 28/ TCR 36/TCR 41/ TCR 66 alpha CDR1 Homo sapiens (aa) |
| 172 | VYSSGN | TCR 10/TCR 28/ TCR 41/TCR 66 alpha CDR2 Homo sapiens (aa) |
| 173 | VVNFPSRGAGGTSYGKLT | TCR 10 alpha CDR3 Homo sapiens (aa) |
| 174 | ASSLSLTGNYGYT | TCR 10 Beta CDR3 Homo sapiens (aa) |
| 175 | ILSAHSNSGYALN | TCR 11 alpha CDR3 Homo sapiens (aa) |
| 176 | SQVTM | TCR 11 Beta CDR1 Homo sapiens (aa) |
| 177 | ANQGSEA | TCR 11 Beta CDR2 Homo sapiens (aa) |
| 178 | SVVPWTRGGSTDTQY | TCR 11 Beta CDR3 Homo sapiens (aa) |
| 179 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASSL SLTGNYGYTFGSGTRLTVVEDLNKVFPPEVAVFEPSEAEISHTQKATLVCLATGFFPDH VELSWWVNGKEVHSGVSTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDF | TCR 10 - Beta Native Homo sapiens (aa) |
| 180 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASSL SLTGNYGYTFGSGTRLTVVEDLNKVFPPEVAVFEPSEAEISHTQKATLVCLATGFFPDH VELSWWVNGKEVHSGVCTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDF | TCR 10 - Beta Cysteine-modified Homo sapiens (aa) |
| 181 | MSLSSLLKVVTASLWLGPGI | TCR 3/TCR 9/ TCR 5/TCR 15/ TCR 17/TCR 19/ TCR 21/TCR 23/ TCR 24/TCR 25/ TCR 26/TCR 29- |

-continued

| SEQ ID NO. | SEQUENCE | DESCRIPTION |
|---|---|---|
| | | (E6)29 TCR alpha signal peptide<br>*Homo sapiens*<br>(aa) |
| 182 | MGTRLLCWVVLGFLGTDHT | TCR 3/TCR 13/TCR 37 - Beta signal peptide<br>*Homo sapiens*<br>(aa) |
| 183 | ATGAAGACATTTGCTGGATTTTCGTTCCTGTTTTTGTGGCTGCAGCTGGACTGTAT<br>GAGTAGAGGAGAGGATGTGGAGCAGAGTCTTTTCCTGAGTGTCCGAGAGGGAGA<br>CAGCTCCGTTATAAACTGCACTTACACAGACAGCTCCTCCACCTACTTATACTGGT<br>ATAAGCAAGAACCTGGAGCAGGTCTCCAGTTGCTGACGTATATTTTTCAAATATG<br>GACATGAAACAAGACCAAAGACTCACTGTTCTATTGAATAAAAAGGATAAACATC<br>TGTCTCTGCGCATTGCAGACACCCAGACTGGGGACTCAGCTATCTACTTCTGTGCA<br>GTCCCCTCGGGTGCTACAAACAAGCTCATCTTTGGAACTGGCACTCTGCTTGCTGT<br>CCAGCCAAATATCCAGAACCCTGACCCTGCCGTGTACCAGCTGAGAGACTCTAAA<br>TCCAGTGACAAGTCTGTCTGCCTATTCACCGATTTTGATTCTCAAACAAATGTGTC<br>ACAAAGTAAGGATTCTGATGTGTATATCACAGACAAATGCGTGCTAGACATGAGG<br>TCTATGGACTTCAAGAGCAACAGTGCTGTGGCCTGGAGCAACAAATCTGACTTTG<br>CATGTGCAAACGCCTTCAACAACAGCATTATTCCAGAAGACACCTTCTTCCCCAGC<br>CCAGAAAGTTCCTGTGATGTCAAGCTGGTCGAGAAAAGCTTTGAAACAGATACGA<br>ACCTAAACTTTCAAAACCTGTCAGTGATTGGGTTCCGAATCCTCCTCCTGAAAGTG<br>GCCGGGTTTAATCTGCTCATGACGCTGCGGCTG | TCR 12 - Alpha Native<br>*Homo sapiens*<br>(nt) |
| 184 | MKLVTSITVLLSLGIMG | TCR 4/TCR 27-(E6)29 alpha signal peptide<br>*Homo sapiens*<br>(aa) |
| 185 | MGTSLLCWMALCLLGADHADT | TCR 4 - (E6)29 Beta signal peptide<br>*Homo sapiens*<br>(aa) |
| 186 | MGIRLLCRVAFCFLAVGLV | TCR 5/TCR 16/TCR 17/TCR 18/TCR 19/TCR 23/TCR 24/TCR 25/TCR 28 - (E6)29/TCR 8/TCR10/TCR 14 - TCR beta signal peptide<br>*Homo sapiens*<br>(aa) |
| 187 | MKTFAGFSFLFLWLQLDCMSR | TCR 6/TCR 12/TCR 50/TCR 55-alpha signal peptide<br>*Homo sapiens*<br>(aa) |
| 188 | MDTWLVCWAIFSLLKAGLT | TCR 6/7/12/33/36/39/43/47/49/51/54/55/30/66 - Beta signal peptide<br>*Homo sapiens*<br>(aa) |
| 189 | MKKHLTTFLVILWLYFYRGNG | TCR 7/TCR 54-(E7)11 - alpha signal peptide<br>*Homo sapiens*<br>(aa) |

| SEQ ID NO. | SEQUENCE | DESCRIPTION |
|---|---|---|
| 190 | METLLGLLILWLQLQWVSS | TCR 8/TCR 16/ TCR 18 - alpha signal peptide Homo sapiens (aa) |
| 191 | MSLGLLCCGAFSLLWAGPV | TCR 9/TCR 26- Beta signal peptide Homo sapiens (aa) |
| 192 | MMISLRVLLVILWLQLSWVWSQ | TCR 10/TCR 28/ TCR 36/TCR 41/ TCR 66- alpha signal peptide Homo sapiens (aa) |
| 193 | MKLVTSITVLLSLGIMG | TCR 11 - alpha signal peptide Homo sapiens (aa) |
| 194 | MLSLLLLLLGLGSVF | TCR 11 - Beta signal peptide Homo sapiens (aa) |
| 195 | MKLVTSITVLLSLGIMGDAKTTQPNSMESNEEEPVHLPCNHSTISGTDYIHWYRQLPSQ GPEYVIHGLTSNVNNRMASLAIAEDRKSSTLILHRATLRDAAVYYCILSAHSNSGYAL NFGKGTSLLVTPHIQNPDPAVYQLRDSKSSDKSVCLFTDFDSQTNVSQSKDSDVYITD KTVLDMRSMDFKSNSAVAWSNKSDFACANAFNNSIIPEDTFFPSPESSCDVKLVEKSF ETDTNLNFQNLSVIGFRILLLKVAGFNLLMTLRLWSS | TCR 11 - Alpha Native Homo sapiens (aa) |
| 196 | NIQNPDPAVYQLRDSKSSDKSVCLFTDFDSQTNVSQSKDSDVYITDKCVLDMRSMDF KSNSAVAWSNKSDFACANAFNNSIIPEDTFFPSPESSCDVKLVEKSFETDTNLNFQNLS VIGFRILLLKVAGFNLLMTLRLWSS | TCR 4 - (E6)29/ TCR 5 - (E6)29/ TCR 12/TCR 55- TCR alpha constant region Homo sapiens (aa) |
| 197 | EDLNKVFPPEVAVFEPSEAEISHTQKATLVCLATGFFPDHVELSWWVNGKEVHSGVC TDPQPLKEQPALNDSRYCLSSRLRVSATFWQNPRNHFRCQVQFYGLSENDEWTQDRA KPVTQIVSAEAWGRADCGFTSVSYQQGVLSATILYEILLGKATLYAVLVSALVLMAM VKRKDF | TCR 4/5/7/10/14/16/17/ 18/21/22/23/25/27/ 28/30/37/39/50/ 54 - TCR beta constant region Homo sapiens (aa) |
| 198 | NIQKPDPAVYQLRDSKSSDKSVCLFTDFDSQTNVSQSKDSDVYITDKCVLDMRSMDF KSNSAVAWSNKSDFACANAFNNSIIPADTFFPSPESSCDVKLVEKSFETDTNLNFQNLS VIGFRILLLKVAGFNLLMTLRLWSS | TCR 3/ TCR 10 TCR alpha constant region Homo sapiens (aa) |
| 199 | EDLKNVFPPEVAVFEPSEAEISHTQKATLVCLATGFYPDHVELSWWVNGKEVHSGVC TDPQPLKEQPALNDSRYCLSSRLRVSATFWQNPRNHFRCQVQFYGLSENDEWTQDRA KPVTQIVSAEAWGRADCGFTSESYQQGVLSATILYEILLGKATLYAVLVSALVLMAM VKRKDSRG | TCR 3/ 6/8/9/11/13/19/ 20/24/29/31/32/ 33/34/35/36/38/ 40/41/42/43/ 45/46/47/48/49/ 51/52/55/66 - TCR beta constant region Homo sapiens (aa) |

| SEQ ID NO. | SEQUENCE | DESCRIPTION |
|---|---|---|
| 200 | HIQNPDPAVYQLRDSKSSDKSVCLFTDFDSQTNVSQSKDSDVYITDKCVLDMRSMDF KSNSAVAWSNKSDFACANAFNNSIIPEDTFFPSPESSCDVKLVEKSFETDTNLNFQNLS VIGFRILLLKVAGFNLLMTLRLWSS | TCR 6/ TCR 11 alpha constant region Homo sapiens (aa) |
| 201 | YIQNPDPAVYQLRDSKSSDKSVCLFTDFDSQTNVSQSKDSDVYITDKCVLDMRSMDF KSNSAVAWSNKSDFACANAFNNSIIPEDTFFPSPESSCDVKLVEKSFETDTNLNFQNLS VIGFRILLLKVAGFNLLMTLRLWSS | TCR 7/TCR 14/ TCR 15/TCR 20/TCR 36/TCR 54/TCR 66 - alpha constant region Homo sapiens (aa) |
| 202 | ATGCTCCTGCTGCTCGTCCCAGTGCTCGAGGTGATTTTTACTCTGGGAGGAACCAG AGCCCAGTCGGTGACCCAGCTTGACAGCCACGTCTCTGTCTCTGAAGGAACCCCG GTGCTGCTGAGGTGCAACTACTCATCTTCTTATTCACCATCTCTCTTCTGGTATGTG CAACACCCCAACAAAGGACTCCAGCTTCTCCTGAAGTACACATCAGCGGCCACCC TGGTTAAAGGCATCAACGGTTTTGAGGCTGAATTTAAGAAGAGTGAAACCTCCTT CCACCTGACGAAACCCTCAGCCCATATGAGCGACGCGGCTGAGTACTTCTGTGTT GTGAGGGGAGGAAAGCTTATCTTCGGACAGGGAACGGAGTTATCTGTGAAACCCA ATATCCAGAACCCTGACCCTGCCGTGTACCAGCTGAGAGACTCTAAATCCAGTGA CAAGTCTGTCTGCCTATTCACCGATTTTGATTCTCAAACAAATGTGTCACAAAGTA AGGATTCTGATGTGTATATCACAGACAAATGCGTGCTAGACATGAGGTCTATGGA CTTCAAGAGCAACAGTGCTGTGGCCTGGAGCAACAAATCTGACTTTGCATGTGCA AACGCCTTCAACAACAGCATTATTCCAGAAGACACCTTCTTCCCCAGCCCAGAAA GTTCCTGTGATGTCAAGCTGGTCGAGAAAAGCTTTGAAACAGATACGAACCTAAA CTTTCAAAACCTGTCAGTGATTGGGTTCCGAATCCTCCTCCTGAAAGTGGCCGGGT TTAATCTGCTCATGACGCTGCGGCTG | TCR 13 - Alpha Native Homo sapiens (nt) |
| 203 | NIQNPDPAVYQLRDSKSSDKSVCLFTDFDSQTNVSQSKDSDVYITDKCVLDMRSMDF KSNSAVAWSNKSDFACANAFNNSIIPEDTFFPSPESSCDVKLVEKSFETDTNLNFQNLS VIGFRILLLKVAGFNLLMTLRLWSS | TCR 8/9/13/16/17/18/ 21/26/27/28/30/31/ 32/33/34/35/37/38/ 39/40/41/42/43/ 44/45/46/48/49/ 50/51/52/53 - alpha constant region Homo sapiens (aa) |
| 204 | GSGATNFSLLKQAGDVEENPGP | P2A Artificial (aa) |
| 205 | MKLVTSITVLLSLGIMGDAKTTQPNSMESNEEEPVHLPCNHSTISGTDYIHWYRQLPSQ GPEYVIHGLTSNVNNRMASLAIAEDRKSSTLILHRATLRDAAVYYCILSAHSNSGYAL NFGKGTSLLVTPHIQNPDPAVYQLRDSKSSDKSVCLFTDFDSQTNVSQSKDSDVYITD KCVLDMRSMDFKSNSAVAWSNKSDFACANAFNNSIIPEDTFFPSPESSCDVKLVEKSF ETDTNLNFQNLSVIGFRILLLKVAGFNLLMTLRLWSS | TCR 11 - Alpha Cysteine- modified Homo sapiens (aa) |
| 206 | MLSLLLLLLGLGSVFSAVISQKPSRDICQRGTSLTIQCQVDSQVTMMFWYRQQPGQSL TLIATANQGSEATYESGFVIDKFPISRPNLTFSTLTVSNMSPEDSSIYLCSVVPWTRGGS TDTQYFGPGTRLTVLEDLKNVFPPEVAVFEPSEAEISHTQKATLVCLATGFYPDHVELS WWVNGKEVHSGVSTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRG | TCR 11 - Beta Native Homo sapiens (aa) |
| 207 | GGATCCGGAGCTACCAACTTCTCTCTGCTGAAACAGGCAGGCGATGTGGAGGAAA ATCCTGGGCCA | TCR 3/ TCR 6/ TCR 8/ TCR 9/ TCR 10 TCR 11 P2A Artificial (nt) |

| SEQ ID NO. | SEQUENCE | DESCRIPTION |
|---|---|---|
| 208 | GGGAGTGGAGCAACAAACTTTTCACTGCTGAAGCAGGCCGGCGATGTGGAGGAA AATCCTGGGCCA | TCR 4 P2A Artificial (nt) |
| 209 | GGGTCCGGAGCCACAAATTTTTCTCTGCTGAAACAGGCTGGCGATGTGGAGGAAA ACCCTGGGCCA | TCR 5 P2A Artificial (nt) |
| 210 | GGAAGCGGCGCAACAAACTTTTCCCTGCTGAAACAGGCCGGAGATGTGGAGGAA AATCCTGGCCCA | TCR 7 P2A Artificial (nt) |
| 211 | EGRGSLLTCGDVEENPGP | T2A Artificial (aa) |
| 212 | NIQKPDPAVYQLRDSKSSDKSVCLFTDFDSQTNVSQSKDSDVYITDKTVLDMRSMDF KSNSAVAWSNKSDFACANAFNNSIIPADTFFPSPESSCDVKLVEKSFETDTNLNFQNLS VIGFRILLLKVAGFNLLMTLRLWSS | TCR 3/ TCR 10 Native TCR alpha constant region Homo sapiens (aa) |
| 213 | NIQNPDPAVYQLRDSKSSDKSVCLFTDFDSQTNVSQSKDSDVYITDKTVLDMRSMDF KSNSAVAWSNKSDFACANAFNNSIIPEDTFFPSPESSCDVKLVEKSFETDTNLNFQNLS VIGFRILLLKVAGFNLLMTLRLWSS | TCR 4/5/12/8/9/13/16/ 17/18/ 21/26/27/28/30/ 31/32/33/34/35/ 37/38/39/40/ 41/42/43/44/45/ 46/48/49/50/51/52/ 53/55 - Native TCR alpha constant region Homo sapiens (aa) |
| 214 | EDLNKVFPPEVAVFEPSEAEISHTQKATLVCLATGFFPDHVELSWWVNGKEVHSGVST DPQPLKEQPALNDSRYCLSSRLRVSATFWQNPRNHFRCQVQFYGLSENDEWTQDRAK PVTQIVSAEAWGRADCGFTSVSYQQGVLSATILYEILLGKATLYAVLVSALVLMAMV KRKDF | TCR 4/5/16/17/18/21/ 22/23/25/27/28/7/ 37/39/50/51/52/ 54/10/14 - Native TCR beta constant region Homo sapiens (aa) |
| 215 | PNIQKPDPAVYQLRDSKSSDKSVCLFTDFDSQTNVSQSKDSDVYITDKTVLDMRSMDF KSNSAVAWSNKSDFACANAFNNSIIPADTFFPSPESSCDVKLVEKSFETDTNLNFQNLS VIGFRILLLKVAGFNLLMTLRLWSS | TCR 3/ TCR 10 Native TCR alpha constant region Homo sapiens (aa) |
| 216 | EDLKNVFPPEVAVFEPSEAEISHTQKATLVCLATGFYPDHVELSWWVNGKEVHSGVS TDPQPLKEQPALNDSRYCLSSRLRVSATFWQNPRNHFRCQVQFYGLSENDEWTQDRA KPVTQIVSAEAWGRADCGFTSESYQQGVLSATILYEILLGKATLYAVLVSALVLMAM VKRKDSRG | TCR 3/6/12/8/9/11/13/ 19/20/24/29/31/ 32/33/34/35/36/38/ 40/41/42/43/46/ 47/48/49/53/55/66 Native TCR beta constant region Homo sapiens (aa) |

SEQUENCE TABLE

| SEQ ID NO. | SEQUENCE | DESCRIPTION |
|---|---|---|
| 217 | HIQNPDPAVYQLRDSKSSDKSVCLFTDFDSQTNVSQSKDSDVYITDKTVLDMRSMDF KSNSAVAWSNKSDFACANAFNNSIIPEDTFFPSPESSCDVKLVEKSFETDTNLNFQNLS VIGFRILLLLKVAGFNLLMTLRLWSS | TCR 6/ TCR 11 Native TCR alpha constant region *Homo sapiens* (aa) |
| 218 | YIQNPDPAVYQLRDSKSSDKSVCLFTDFDSQTNVSQSKDSDVYITDKTVLDMRSMDF KSNSAVAWSNKSDFACANAFNNSIIPEDTFFPSPESSCDVKLVEKSFETDTNLNFQNLS VIGFRILLLLKVAGFNLLMTLRLWSS | TCR 7/TCR 14/ TCR 15/TCR 20/ TCR 36/TCR 54/TCR 66 - Native TCR alpha constant region *Homo sapiens* (aa) |
| 219 | ATGGAGAAGAATCCTTTGGCAGCCCCATTACTAATCCTCTGGTTTCATCTTGACTG CGTGAGCAGCATACTGAACGTGGAACAAAGTCCTCAGTCACTGCATGTTCAGGAG GGAGACAGCACCAATTTCACCTGCAGCTTCCCTTCCAGCAATTTTTATGCCTTACA CTGGTACAGATGGGAAACTGCAAAAAGCCCCGAGGCCTTGTTTGTAATGACTTTA AATGGGGATGAAAAGAAGAAAGGACGAATAAGTGCCACTCTTAATACCAAGGAG GGTTACAGCTATTTGTACATCAAAGGATCCCAGCCTGAAGACTCAGCCACATACC TCTGTGCCTCTCAAACTGGGGCAAACAACCTCTTCTTTGGGACTGGAACGAGACTC ACCGTTATTCCCTATATCCAGAACCCTGACCCTGCCGTGTACCAGCTGAGAGACTC TAAATCCAGTGACAAGTCTGTCTGCCTATTCACCGATTTTGATTCTCAAACAAATG TGTCACAAAGTAAGGATTCTGATGTGTATATCACAGACAAAACTGTGCTAGACAT GAGGTCTATGGACTTCAAGAGCAACAGTGCTGTGGCCTGGAGCAACAAATCTGAC TTTGCATGTGCAAACGCCTTCAACAACAGCATTATTCCAGAAGACACCTTCTTCCC CAGCCCAGAAAGTTCCTGTGATGTCAAGCTGGTCGAGAAAAGCTTTGAAACAGAT ACGAACCTAAACTTTCAAAACCTGTCAGTGATTGGGTTCCGAATCCTCCTCCTGAA AGTGGCCGGGTTTAATCTGCTCATGACGCTGCGGCTG | TCR 14 - Alpha Native *Homo sapiens* (nt) |
| 220 | PNIQNPDPAVYQLRDSKSSDKSVCLFTDFDSQTNVSQSKDSDVYITDKTVLDMRSMDF KSNSAVAWSNKSDFACANAFNNSIIPEDTFFPSPESSCDVKLVEKSFETDTNLNFQNLS VIGFRILLLLKVAGFNLLMTLRLWSS | TCR 4 - (E6)29/ TCR 5/TCR 12/ TCR 8/ TCR 9/TCR 13- (E6)29 - Native TCR alpha constant region *Homo sapiens* (aa) |
| 221 | MLSLLLLLLGLGSVFSAVISQKPSRDICQRGTSLTIQCQVDSQVTMMFWYRQQPGQSL TLIATANQGSEATYESGFVIDKFPISRPNLTFSTLTVSNMSPEDSSIYLCSVVPWTRGGS TDTQYFGPGTRLTVLEDLKNVFPPEVAVFEPSEAEISHTQKATLVCLATGFYPDHVELS WWVNGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRG | TCR 11 - Beta Cysteine-modified *Homo sapiens* (aa) |
| 222 | MKTFAGFSFLFLWLQLDCMSRGEDVEQSLFLSVREGDSSVINCTYTDSSSTYLYWYK QEPGAGLQLLTYIFSNMDMKQDQRLTVLLNKKDKHLSRIADTQTGDSAIYFCAVPS GATNKLIFGTGTLLAVQPNIQNPDPAVYQLRDSKSSDKSVCLFTDFDSQTNVSQSKDS DVYITDKTVLDMRSMDFKSNSAVAWSNKSDFACANAFNNSIIPEDTFFPSPESSCDVK LVEKSFETDTNLNFQNLSVIGFRILLLLKVAGFNLLMTLRLWSS | TCR 12/TCR 55- (E7)11 -alpha native *Homo sapiens* (aa) |
| 223 | MGTRLLCWVVLGFLGTDHTGAGVSQSPRYKVAKRGQDVALRCDPISGHVSLFWYQQ ALGQGPEFLTYFQNEAQLDKSGLPSDRFFAERPEGSVSTLKIQRTQQEDSAVYLCASS HLAGFTGELFFGEGSRLTVLEDLKNVFPPEVAVFEPSEAEISHTQKATLVCLATGFYPD HVELSWWVNGKEVHSGVSTDPQPLKEQPALNDSRYCLSSRLRVSATFWQNPRNHFR CQVQFYGLSENDEWTQDRAKPVTQIVSAEAWGRADCGFTSESYQQGVLSATILYEILL GKATLYAVLVSALVLMAMVKRKDSRGGSGATNFSLLKQAGDVEENPGPMSLSSLLK VVTASLWLGPGIAQKITQTQPGMFVQEKEAVTLDCTYDTSDQSYGLFWYKQPSSGEM IFLIYQGSYDEQNATEGRYSLNFQKARKSANLVISASQLGDSAMYFCAMREGRGFKTI FGAGTRLFVKANIQKPDAVYQLRDSKSSDKSVCLFTDFDSQTNVSQSKDSDVYITDK TVLDMRSMDFKSNSAVAWSNKSDFACANAFNNSIIPADTFFPSPESSCDVKLVEKSFE TDTNLNFQNLSVIGFRILLLLKVAGFNLLMTLRLWSS | TCR 3 Full sequence Native *Homo sapiens* (aa) |

SEQUENCE TABLE

| SEQ ID NO. | SEQUENCE | DESCRIPTION |
|---|---|---|
| 224 | MGTSLLCWMALCLLGADHADTGVSQDPRHKITKRGQNVTFRCDPISEHNRLYWYRQ TLGQGPEFLTYFQNEAQLEKSRLLSDRFSAERPKGSFSTLEIQRTEQGDSAMYLCASSP GGGNTEAFFGQGTRLTVVEDLNKVFPPEVAVFEPSEAEISHTQKATLVCLATGFFPDH VELSWWVNGKEVHSGVSTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDFGSGATNFSLLKQAGDVEENPGPMKLVTSITVL LSLGIMGDAKTTQPNSMESNEEEPVHLPCNHSTISGTDYIHWYRQLPSQGPEYVIHGLT SNVNNRMASLAIAEDRKSSTLILHRATLRDAAVYYCILLVIRGTSYGKLTFGQGTILTV HPNIQNPDDPAVYQLRDSKSSDKSVCLFTDFDSQTNVSQSKDSDVYITDKTVLDMRSM DFKSNSAVAWSNKSDFACANAFNNSIIPEDTFFPSPESSCDVKLVEKSFETDTNLNFQN LSVIGFRILLLKVAGFNLLMTLRLWSS | TCR 4 - (E6)29 Full sequence Native Homo sapiens (aa) |
| 225 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASSP WGETHQPQHFGDGTRLSILEDLNKVFPPEVAVFEPSEAEISHTQKATLVCLATGFFPDH VELSWWVNGKEVHSGVSTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDFGSGATNFSLLKQAGDVEENPGPMSLSSLLKVV TASLWLGPGIAQKITQTQPGMFVQEKEAVTLDCTYDTSDQSYGLFWYKQPSSGEMIFL IYQGSYDEQNATEGRYSLNFQKARKSANLVISASQLGDSAMYFCAMREGTGTSYGKL TFGQGTILTVHPNIQNPDDPAVYQLRDSKSSDKSVCLFTDFDSQTNVSQSKDSDVYITDK TVLDMRSMDFKSNSAVAWSNKSDFACANAFNNSIIPEDTFFPSPESSCDVKLVEKSFET DTNLNFQNLSVIGFRILLLKVAGFNLLMTLRLWSS | TCR 5 - (E6)29 - TCR Full sequence Native Homo sapiens (aa) |
| 226 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCASTTRS SYEQYFGPGTRLTVTEDLNKVFPPEVAVFEPSEAEISHTQKATLVCLATGFPDHVELS WWVNGKEVHSGVSTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRGGSGATNFSLLKQAGDVEENPGPMKTFAGFSFLFLW LQLDCMSRGEDVEQSLFLSVREGDSSVINCTYTDSSSTYLYWYKQEPGAGLQLLTYIF SNMDMKQDQRLTVLLNKKDKHLSLRIADTQTGDSAIYFCAESIRGFGNVLHCGSGTQ VIVLPHIQNPDDPAVYQLRDSKSSDKSVCLFTDFDSQTNVSQSKDSDVYITDKTVLDMR SMDFKSNSAVAWSNKSDFACANAFNNSIIPEDTFFPSPESSCDVKLVEKSFETDTNLNF QNLSVIGFRILLLKVAGFNLLMTLRLWSS | TCR 6 Full sequence Native Homo sapiens (aa) |
| 227 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCAITDRT NYGYTFGSGTRLTVVEDLNKVFPPEVAVFEPSEAEISHTQKATLVCLATGFFPDHVELS WWVNGKEVHSGVSTDPQPLKEQPALNDSRYCLSSRLRVSATFWQNPRNHFRCQVQF YGLSENDEWTQDRAKPVTQIVSAEAWGRADCGFTSVSYQQGVLSATILYEILLGKAT LYAVLVSALVLMAMVKRKDFGSGATNFSLLKQAGDVEENPGPMKKHLTTFLVILWL YFYRGNGKNQVEQSPQSLIILEGKNCTLQCNYTVSPFSNLRWYKQDTGRGPVSLTIMT FSENTKSNGRYTATLDADTKQSSLHITASQLSDSASYICVVSRDNYGQNFVFGPGTRLS VLPYIQNPDDPAVYQLRDSKSSDKSVCLFTDFDSQTNVSQSKDSDVYITDKTVLDMRSM DFKSNSAVAWSNKSDFACANAFNNSIIPEDTFFPSPESSCDVKLVEKSFETDTNLNFQN LSVIGFRILLLKVAGFNLLMTLRLWSS | TCR 7/TCR 54- (E7)11 - Full sequence Native Homo sapiens (aa) |
| 228 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASSL WGASTDTQYFGPGTRLTVLEDLKNVFPPEVAVFEPSEAEISHTQKATLVCLATGFYPD HVELSWWVNGKEVHSGVSTDPQPLKEQPALNDSRYCLSSRLRVSATFWQNPRNHFR CQVQFYGLSENDEWTQDRAKPVTQIVSAEAWGRADCGFTSESYQQGVLSATILYEILL GKATLYAVLVSALVLMAMVKRKDSRGGSGATNFSLLKQAGDVEENPGPMETLLGLL ILWLQLQWVSSKQEVTQIPAALSVPEGENLVLNCSFTDSAIYNLQWFRQDPGKGLTSL LLIQSSQREQTSGRLNASLDKSSGRSTLYIAASQPGDSATYLCAVRPLGNTPLVFGKGT RLSVIANIQNPDDPAVYQLRDSKSSDKSVCLFTDFDSQTNVSQSKDSDVYITDKTVLDM RSMDFKSNSAVAWSNKSDFACANAFNNSIIPEDTFFPSPESSCDVKLVEKSFETDTNLN FQNLSVIGFRILLLKVAGFNLLMTLRLWSS | TCR 8 Full sequence Native Homo sapiens (aa) |
| 229 | MSLGLLCCGAFSLLWAGPVNAGVTQTPKFRVLKTGQSMTLLCAQDMNHEYMYWYR QDPGMGLRLIHYSVGEGTTAKGEVPDGYNVSRLKKQNFLLGLESAAPSQTSVYFCAS SYFGTAYEQYFGPGTRLTVTEDLKNVFPPEVAVFEPSEAEISHTQKATLVCLATGFYPD HVELSWWVNGKEVHSGVSTDPQPLKEQPALNDSRYCLSSRLRVSATFWQNPRNHFR CQVQFYGLSENDEWTQDRAKPVTQIVSAEAWGRADCGFTSESYQQGVLSATILYEILL GKATLYAVLVSALVLMAMVKRKDSRGGSGATNFSLLKQAGDVEENPGPMSLSSLLK VVTASLWLGPGIAQKITQTQPGMFVQEKEAVTLDCTYDTSDPSYGLFWYKQPSSGEM IFLIYQGSYDQQNATEGRYSLNFQKARKSANLVISASQLGDSAMYFCAMRTAGGTSY GKLTFGQGTILTVHPNIQNPDDPAVYQLRDSKSSDKSVCLFTDFDSQTNVSQSKDSDVYI TDKTVLDMRSMDFKSNSAVAWSNKSDFACANAFNNSIIPEDTFFPSPESSCDVKLVEK SFETDTNLNFQNLSVIGFRILLLKVAGFNLLMTLRLWSS | TCR 9 - Full sequence Native Homo sapiens (aa) |

| SEQ ID NO. | SEQUENCE | DESCRIPTION |
|---|---|---|
| 230 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASSL SLTGNYGYTFGSGTRLTVVEDLNKVFPPEVAVFEPSEAEISHTQKATLVCLATGFFPDH VELSWWVNGKEVHSGVSTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDFGSGATNFSLLKQAGDVEENPGPMMISLRVLLV ILWQLSWVWSQRKEVEQDPGPFNVPEGATVAFNCTYSNSASQSFFWYRQDCRKEPK LLMSVYSSGNEDGRFTAQLNRASQYISLLIRDSKLSDSATYLCVVNFPSRGAGGTSYG KLTFGQGTILTVHPNIQKPDPAVYQLRDSKSSDKSVCLFTDFDSQTNVSQSKDSDVYIT DKTVLDMRSMDFKSNSAVAWSNKSDFACANAFNNSIIPADTFFPSPESSCDVKLVEKS FETDTNLNFQNLSVIGFRILLLKVAGFNLLMTLRLWSS | TCR 10 Full sequence Native *Homo sapiens* (aa) |
| 231 | MLSLLLLLLGLGSVFSAVISQKPSRDICQRGTSLTIQCQVDSQVTMMFWYRQQPGQSL TLIATANQGSEATYESGFVIDKFPISRPNLTFSTLTVSNMSPEDSSIYLCSVVPWTRGGS TDTQYFGPGTRLTVLEDLKNVFPPEVAVFEPSEAEISHTQKATLVCLATGFYPDHVELS WWVNGKEVHSGVSTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRGGSGATNFSLLKQAGDVEENPGPMKLVTSITVLLSL GIMGDAKTTQPNSMESNEEEPVHLPCNHSTISGTDYIHWYRQLPSQGPEYVIHGLTSN VNNRMASLAIAEDRKSSTLILHRATLRDAAVYYCILSAHSNSGYALNFGKGTSLLVTP HIQNPDPAVYQLRDSKSSDKSVCLFTDFDSQTNVSQSKDSDVYITDKTVLDMRSMDF KSNSAVAWSNKSDFACANAFNNSIIPEDTFFPSPESSCDVKLVEKSFETDTNLNFQNLS VIGFRILLLKVAGFNLLMTLRLWSS | TCR 11 Full sequence Native *Homo sapiens* (aa) |
| 232 | KLPQLCTEL | E6(18-26) peptide |
| 233 | TIHDIILECV | E6(29-38) peptide |
| 234 | FAFRDLCIV | E6(52-60) peptide |
| 235 | TLGIVCPI | E7(86-93) peptide |
| 236 | YMLDLQPET | E7(11-19) peptide |
| 237 | GTLGIVCPI | E7(85-93) peptide |
| 238 | LLMGTLGIV | E7(82-90) peptide |
| 239 | TLHEYMLDL | E7(7-15) peptide |
| 240 | $X_1X_2X_3X_4X_5X_6X_7$<br>$X_1$ = T, D, S, or N;<br>$X_2$ = I, or S;<br>$X_3$ = S, D, N, Y, or A;<br>$X_4$ = G, Q, P, or null;<br>$X_5$ = T, S, F, or I;<br>$X_6$ = D, Y, P, or Q;<br>$X_7$ = Y, G, N, A, S, or Q | TCR alpha E6(29-38) CDR1 consensus |
| 241 | $X_1X_2X_3X_4X_5X_6$<br>$X_1$ = D or V;<br>$X_3$ = S, or P;<br>$X_4$ = S or F;<br>$X_5$ = T or S;<br>$X_6$ = Y or N | TCR alpha E7(11-19) CDR1 consensus |
| 242 | MKTFAGFSFLFLWLQLDCMSRGEDVEQSLFLSVREGDSSVINCTYTDSSSTYLYWYK QEPGAGLQLLTYIFSNMDMKQDQRLTVLLNKKDKHLSRIADTQTGDSAIYFCAVPS GATNKLIFGTGTLLAVQPNIQNPDPAVYQLRDSKSSDKSVCLFTDFDSQTNVSQSKDS DVYITDKCVLDMRSMDFKSNSAVAWSNKSDFACANAFNNSIIPEDTFFPSPESSCDVK LVEKSFETDTNLNFQNLSVIGFRILLLKVAGFNLLMTLRLWSS | TCR 12/TCR 55-(E7)11 - Alpha Cysteine-modified *Homo sapiens* (aa) |
| 243 | $X_1X_2X_3X_4X_5X_6X_7$<br>$X_1$ = T, D, N, S, or V;<br>$X_2$ = I or S;<br>$X_3$ = S, D, A, P, N, or Y<br>$X_4$ = G, Q, P, or null;<br>$X_5$ = T, S, I, or F;<br>$X_6$ = D, Y, Q, T, P, or S;<br>$X_7$ = Y, G, N, A, S, or Q; | TCR alpha overall CDR1 consensus |

| SEQ ID NO. | SEQUENCE | DESCRIPTION |
|---|---|---|
| 244 | $X_1X_2X_3X_4X_5X_6X_7X_8$<br>$X_1$ = G, Q, I, M, Y, or V;<br>$X_2$ = L, S, Q, T, or Y;<br>$X_3$ = T, G, L, or S;<br>$X_4$ = Y, S, N, A, or null;<br>$X_5$ = null, A, or D;<br>$X_6$ = null, E, Q, T, or S;<br>$X_7$ = S, Q, R, L, or G;<br>$X_8$ = N, V, or E; | TCR alpha E6(29-38) CDR2 consensus |
| 245 | $X_1X_2X_3X_4X_5X_6X_7$<br>$X_1$ = I or M;<br>$X_2$ = F or T;<br>$X_3$ = S or F;<br>$X_4$ = N or S;<br>$X_5$ = M or E;<br>$X_6$ = D or N;<br>$X_7$ = M or T; | TCR alpha E7(11-19) CDR2 consensus |
| 246 | MDTWLVCWAIFSLLKAGLTEPEVTQTPSHQVTQMGQEVILRCVPISNHLYFYWRQI<br>LGQKVEFLVSFYNNEISEKSEIFDDQFSVERPDGSNFTLKIRSTKLEDSAMYFCASTTRS<br>SYEQYFGPGTRLTVTEDLKNVFPPEVAVFEPSEAEISHTQKATLVCLATGFYPDHVELS<br>WWVNGKEVHSGVSTDPQPLKEQPALNDSRYCLSSRLRVSATFWQNPRNHFRCQVQF<br>YGLSENDEWTQDRAKPVTQIVSAEAWGRADCGFTSESYQQGVLSATILYEILLGKATL<br>YAVLVSALVLMAMVKRKDSRG | TCR 6, TCR 12, TCR 55 - (E7)11 - Beta Native *Homo sapiens* (aa) |
| 247 | $X_1X_2X_3X_4X_5X_6X_7X_8$<br>$X_1$ = G, Q, I, V, Y, or M;<br>$X_2$ = L, S, Q, Y, F, or T;<br>$X_3$ = T, G, S, L, or F;<br>$X_4$ = Y, S, N, A, or null;<br>$X_5$ = null, A, or D;<br>$X_6$ = null, E, Q, S, M, or T;<br>$X_7$ = S, Q, R, G, D, L, or N;<br>$X_8$ = N, E, M, T, or V | TCR alpha overall CDR2 consensus |
| 248 | $X_1X_2X_3X_4X_5X_6X_7X_8X_9X_{10}X_{11}X_{12}X_{13}X_{14}X_{15}X_{16}X_{17}X_{18}$<br>$X_1$ = A, I, or V;<br>$X_2$ = M, L, S, or V;<br>$X_3$ = R, L, Q, or N;<br>$X_4$ = E, V, T, P, G, or F;<br>$X_5$ = G, I, L, A, null, or P;<br>$X_6$ = R, T, G, null, or S;<br>$X_7$ = G, R, or null;<br>$X_8$ = T, G, or null;<br>$X_9$ = null or A;<br>$X_{10}$ = null or G;<br>$X_{11}$ = null or G;<br>$X_{12}$ = null or T;<br>$X_{13}$ = null or S;<br>$X_{14}$ = G, Y, null, or N;<br>$X_{15}$ = F, G, N, or T;<br>$X_{16}$ = K or N, P;<br>$X_{17}$ = T or L;<br>$X_{18}$ = I, V, F or T | TCR alpha E6(29-38) CDR3 consensus |
| 249 | $X_1X_2X_3X_4X_5X_6X_7X_8X_9X_{10}X_{11}$<br>$X_1$ = A or V;<br>$X_2$ = E or V;<br>$X_3$ = S or P<br>$X_4$ = I, S, or R;<br>$X_5$ = R, G, or D;<br>$X_6$ = G, A, or N;<br>$X_7$ = F, null, or Y;<br>$X_8$ = G or T<br>$X_9$ = N, T, or Q;<br>$X_{10}$ = V, K or N;<br>$X_{11}$ = L or F;<br>$X_{12}$ = H, I, or V | TCR alpha E7(11-19) CDR3 consensus |

-continued

SEQUENCE TABLE

| SEQ ID NO. | SEQUENCE | DESCRIPTION |
|---|---|---|
| 250 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCASTTRS SYEQYFGPGTRLTVTEDLKNVFPPEVAVFEPSEAEISHTQKATLVCLATGFYPDHVELS WWVNGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRG | TCR 6, TCR 12, TCR 55 − (E7)11- Beta Cysteine- modified Homo sapiens (aa) |
| 251 | $X_1X_2X_3X_4X_5X_6X_7X_8X_9X_{10}X_{11}X_{12}X_{13}X_{14}X_{15}X_{16}X_{17}X_{18}$<br>$X_1$ = A, I, or V;<br>$X_2$ = M, L, V, E, or S;<br>$X_3$ = R, L, N, Q, P, or S;<br>$X_4$ = E, V, P, T, F, I, R, G, S, or A;<br>$X_5$ = G, I, L, A, P, R, D, null, or H;<br>$X_6$ = R, T, G, S, N, null, or A;<br>$X_7$ = G, R, N, or null;<br>$X_8$ = T, G, or null;<br>$X_9$ = null or A;<br>$X_{10}$ = null or G;<br>$X_{11}$ = null or G;<br>$X_{12}$ = null or T;<br>$X_{13}$ = F, Y, S or null;<br>$X_{14}$ = G, Y, null, or N;<br>$X_{15}$ = F, G, T, N, Q, or Y;<br>$X_{16}$ = K, P, V, N or A;<br>$X_{17}$ = T, L, or F;<br>$X_{18}$ = I, V, T, H, F, or N | TCR alpha overall CDR3 consensus |
| 252 | $X_1X_2X_3X_4X_5$<br>$X_1$ = S or M;<br>$X_2$ = G, E, D, or N;<br>$X_4$ = V, N, or E;<br>$X_5$ = S, R, N, or Y; | TCR beta E6(29-38) CDR1 consensus |
| 253 | MLLLLVPVLEVIFTLGGTRAQSVTQLDSHVSVSEGTPVLLRCNYSSSYSPSLFWYVQH PNKGLQLLLKYTSAATLVKGINGFEAEFKKSETSFHLTKPSAHMSDAAEYFCVVRGG KLIFGQGTELSVKPNIQNPDPAVYQLRDSKSSDKSVCLFTDFDSQTNVSQKDSDVYIT DKTVLDMRSMDFKSNSAVAWSNKSDFACANAFNNSIIPEDTFFPSPESSCDVKLVEKS FETDTNLNFQNLSVIGFRILLLLKVAGFNLLMTLRLWSS | TCR 13 − Alpha Native Homo sapiens (aa) |
| 254 | $X_1X_2X_3X_4X_5$<br>$X_1$ = S or M;<br>$X_2$ = G, E, D, N, or Q;<br>$X_3$ = H or V;<br>$X_4$ = V, N, E, L, or T;<br>$X_5$ = S, R, N, Y, or M; | TCR beta overall CDR1 consensus |
| 255 | $X_1X_2X_3X_4X_5X_6$<br>$X_1$ = F or S;<br>$X_2$ = Q, Y, or V;<br>$X_3$ = N, D, or G;<br>$X_4$ = E or V;<br>$X_5$ = A, K, or G;<br>$X_6$ = Q, M, or T; | TCR beta E6(29-38) CDR2 consensus |
| 256 | MLLLLVPVLEVIFTLGGTRAQSVTQLDSHVSVSEGTPVLLRCNYSSSYSPSLFWYVQH PNKGLQLLLKYTSAATLVKGINGFEAEFKKSETSFHLTKPSAHMSDAAEYFCVVRGG KLIFGQGTELSVKPNIQNPDPAVYQLRDSKSSDKSVCLFTDFDSQTNVSQKDSDVYIT DKCVLDMRSMDFKSNSAVAWSNKSDFACANAFNNSIIPEDTFFPSPESSCDVKLVEKS FETDTNLNFQNLSVIGFRILLLLKVAGFNLLMTLRLWSS | TCR 13 − Alpha Cysteine- modified Homo sapiens (aa) |
| 257 | $X_1X_2X_3X_4X_5X_6X_7$<br>$X_1$ = F, S, or A;<br>$X_2$ = Q, Y, V, or N;<br>$X_3$ = N, D, G, or Q;<br>$X_5$ = E, V, N, or S;<br>$X_6$ = A, K, G, or E;<br>$X_7$ = Q, M, T, I, or A; | TCR beta overall CDR2 consensus |

SEQUENCE TABLE

| SEQ ID NO. | SEQUENCE | DESCRIPTION |
|---|---|---|
| 258 | AS $X_3X_4X_5X_6X_7X_8X_9X_{10}X_{11}X_{12}X_{13}$<br>$X_3$ = S or T<br>$X_4$ = H, P, L, F, or Y;<br>$X_5$ = L, G, W, F, T, or S;<br>$X_6$ = A, G, or L;<br>$X_7$ = G, E, A, T, Q, or null;<br>$X_8$ = F, G, T, R, or S;<br>$X_9$ = T, N, H, R, E, or A;<br>$X_{10}$ = G, T, Q, D, R, or Y;<br>$X_{11}$ = E, P, T, or G;<br>$X_{12}$ = L, A, Q, or Y;<br>$X_{13}$ = F, H, Y, or T | TCR beta E6(29-38) CDR3 consensus |
| 259 | A$X_2$T$X_4$R$X_6$Y$X_7$Y$X_9X_{10}X_{11}$<br>$X_2$ = S or I;<br>$X_4$ = T or D;<br>$X_6$ = S or T;<br>$X_7$ = S or N;<br>$X_9$ = E or G;<br>$X_{10}$ = Q or Y;<br>$X_{11}$ = Y or T | TCR beta E7(11-19) CDR3 consensus |
| 260 | MGTRLLCWVVLGFLGTDHTGAGVSQSPRYKVAKRGQDVALRCDPISGHVSLFWYQQ<br>ALGQGPEFLTYFQNEAQLDKSGLPSDRFFAERPEGSVSTLKIQRTQQEDSAVYLCASSP<br>TGTERELFFGEGSRLTVEDLKNVFPPEVAVFEPSEAEISHTQKATLVCLATGFYPDHV<br>ELSWWVNGKEVHSGVSTDPQPLKEQPALNDSRYCLSSRLRVSATFWQNPRNHFRCQ<br>VQFYGLSENDEWTQDRAKPVTQIVSAEAWGRADCGFTSESYQQGVLSATILYEILLG<br>KATLYAVLVSALVLMAMVKRKDSRG | TCR 13 - Beta Native Homo sapiens (aa) |
| 261 | $X_1X_2X_3X_4X_5X_6X_7X_8X_9X_{10}X_{11}X_{12}X_{13}X_{14}X_{15}$<br>$X_1$ = A or S;<br>$X_2$ = S, I, or V;<br>$X_3$ = S, T, or V;<br>$X_4$ = H, P, L, Y, T, D, or F;<br>$X_5$ = L, G, W, F, S, T, or R;<br>$X_6$ = A, G, L, S, or T;<br>$X_7$ = G, E, A, T, R, Q, or null;<br>$X_8$ = null or G;<br>$X_9$ = null or G;<br>$X_{10}$ = null, F, G, T, S, or R;<br>$X_{11}$ = T, N, H, A, S, R, or E;<br>$X_{12}$ = G, T, Q, D, Y, or R;<br>$X_{13}$ = E, P, T, or G;<br>$X_{14}$ = L, A, Q, or Y;<br>$X_{15}$ = F, H, Y, or T | TCR beta overall CDR3 consensus |
| 262 | DIQNPEPAVYQLKDPRSQDSTLCLFTDFDSQINVPKTMESGTFITDKTVLDMKAMDSK<br>SNGAIAWSNQTSFTCQDIFKETNATYPSSDVPCDATLTEKSF<br>ETDMNLNFQNLSVMGLRILLLKVAGFNLLMTLRLWSS | Mouse alpha constant Mus musculus (aa) |
| 263 | EDLRNVTPPKVSLFEPSKAEIANKQKATLVCLARGFFPDHVELSWWVNGKEVHSGVS<br>TDPQAYKESNYSYCLSSRLRVSATFWHNPRNHFRCQVQFHGLSEEDKWPEGSPKPVT<br>QNISAEAWGRADCGITSASYQQGVLSATILYEILLGKATLYAVLVSTLVVMAMVKR<br>KNS | Mouse beta constant Mus musculus (aa) |
| 264 | MHQKRTAMFQDPQERPRKLPQLCTELQTTIHDIILECVYCKQQLLRREVYDFAFRDLC<br>IVYRDGNPYAVCDKCLKFYSKISEYRHYCYSLYGTTLEQQYNKPLCDLLIRCINCQKP<br>LCPEEKQRHLDKKQRFHNIRGRWTGRCMSCCRSSRTRRETQL | HPV 16 E6 (aa) |
| 265 | MHGDTPTLHEYMLDLQPETTDLYCYEQLNDSSEEEDEIDGPAGQAEPDRAHYNIVTF<br>CCKCDSTLRLCVQSTHVDIRTLEDLLMGTLGIVCPICSQKP | HPV 16 E7 (aa) |
| 266 | -PGGG-(SGGGG)$_n$-P- wherein n is 5 or 6, P is proline, G is glycine and S is serine | Linker (aa) |
| 267 | GSADDAKKDAAKKDGKS | Linker (aa) |
| 268 | ESKYGPPCPPCP | spacer (IgG4hinge) Homo sapiens (aa) |

| SEQ ID NO. | SEQUENCE | DESCRIPTION |
|---|---|---|
| 269 | GAATCTAAGTACGGACCGCCCTGCCCCCCTTGCCCT | spacer (IgG4hinge) Homo sapiens (nt) |
| 270 | ESKYGPPCPPCPGQPREPQVYTLPPSQEEMTKNQVSLTCLVKGFYPSDIAVEWESNGQ PENNYKTTPPVLDSDGSFFLYSRLTVDKSRWQEGNVFSCSVMHEALHNHYTQKSLSL SLGK | Hinge-CH3 spacer Homo sapiens (aa) |
| 271 | ESKYGPPCPPCPAPEFLGGPSVFLFPPKPKDTLMISRTPEVTCVVVDVSQEDPEVQFNW YVDGVEVHNAKTKPREEQFNSTYRVVSVLTVLHQDWLNGKEYKCKVSNKGLPSSIE KTISKAKGQPREPQVYTLPPSQEEMTKNQVSLTCLVKGFYPSDIAVEWESNGQPENNY KTTPPVLDSDGSFFLYSRLTVDKSRWQEGNVFSCSVMHEALHNHYTQKSLSLSLGK | Hinge-CH2-CH3 spacer Homo sapiens (aa) |
| 272 | RWPESPKAQASSVPTAQPQAEGSLAKATTAPATTRNTGRGGEEKKKEKEKEEQEERE TKTPECPSHTQPLGVYLLTPAVQDLWLRDKATFTCFVVGSDLKDAHLTWEVAGKVPT GGVEEGLLERHSNGSQSQHSRLTLPRSLWNAGTSVTCTLNHPSLPPQRLMALREPAAQ APVKLSLNLLASSDPPEAASWLLCEVSGFSPPNILLMWLEDQREVNTSGFAPARPPPQP GSTTFWAWSVLRVPAPPSPQPATYTCVVSHEDSRTLLNASRSLEVSYVTDH | IgD-hinge-Fc Homo sapiens (aa) |
| 273 | MLLLVTSLLLCELPHPAFLLIPRKVCNGIGIGEFKDSLSINATNIKHFKNCTSISGDLHIL PVAFRGDSFTHTPPLDPQELDILKTVKEITGFLLIQAWPENRTDLHAFENLEIIRGRTKQ HGQFSLAVVSLNITSLGLRSLKEISDGDVIISGNKNLCYANTINWKKLFGTSGQKTKIIS NRGENSCKATGQVCHALCSPEGCWGPEPRDCVSCRNVSRGRECVDKCNLLEGEPREF VENSECIQCHPECLPQAMNITCTGRGPDNCIQCAHYIDGPHCVKTCPAGVMGENNTLV WKYADAGHVCHLCHPNCTYGCTGPGLEGCPTNGPKIPSIATGMVGALLLLLVVALGI GLFM | tEGFR artificial (aa) |
| 274 | LEGGGEGRGSLLTCGDVEENPGPR | T2A Artificial (aa) |
| 275 | FWVLVVVGGVLACYSLLVTVAFIIFWV | CD28 (amino acids 153-179 of Accession No. P10747) Homo sapiens (aa) |
| 276 | IEVMYPPPYLDNEKSNGTIIHVKGKHLCPSPLFPGPSKP FWVLVVVGGVLACYSLLVTVAFIIFWV | CD28 (amino acids 114-179 of Accession No. P10747) Homo sapiens (aa) |
| 277 | RSKRSRLLHSDYMNMTPRRPGPTRKHYQPYAPPRDFAAYRS | CD28 (amino acids 180-220 of P10747) Homo sapiens (aa) |
| 278 | RSKRSRGGHSDYMNMTPRRPGPTRKHYQPYAPPRDFAAYRS | CD28 (LL to GG) Homo sapiens (aa) |
| 279 | KRGRKKLLYIFKQPFMRPVQTTQEEDGCCRFPEEEEGGCEL | 4-1BB (amino acids 214-255 of Q07011.1) Homo sapiens (aa) |
| 280 | RVKFSRSADAPAYQQGQNQLYNELNLGRREEYDVLDKRRGRDPEMGGKPRRKNPQE GLYNELQKDKMAEAYSEIGMKGERRRGKGHDGLYQGLSTATKDTYDALHMQALP PR | CD3 zeta Homo sapiens (aa) |
| 281 | RVKFSRSAEPPAYQQGQNQLYNELNLGRREEYDVLDKRRGRDPEMGGKPRRKNPQE GLYNELQKDKMAEAYSEIGMKGERRRGKGHDGLYQGLSTATKDTYDALHMQALP PR | CD3 zeta Homo sapiens (aa) |

| SEQ ID NO. | SEQUENCE | DESCRIPTION |
|---|---|---|
| 282 | RVKFSRSADAPAYKQGQNQLYNELNLGRREEYDVLDKRRGRDPEMGGKPRRKNPQE GLYNELQKDKMAEAYSEIGMKGERRRGKGHDGLYQGLSTATKDTYDALHMQALP PR | CD3 zeta *Homo sapiens* (aa) |
| 283 | GEDVEQSLFLSVREGDSSVINCTYTDSSSTYLYWYKQEPGAGLQLLTYIFSNMDMKQ DQRLTVLLNKKDKHLSLRIADTQTGDSAIYFCAVPSGATNKLIFGTGTLLAVQPNIQNP DPAVYQLRDSKSSDKSVCLFTDFDSQTNVSQSKDSDVYITDKTVLDMRSMDFKSNSA VAWSNKSDFACANAFNNSIIPEDTFFPSPESSCDVKLVEKSFETDTNLNFQNLSVIGFRI LLLKVAGFNLLMTLRLWSS | TCR 12/TCR 55-(E7)11 alpha native *Homo sapiens* (aa) |
| 284 | GEDVEQSLFLSVREGDSSVINCTYTDSSSTYLYWYKQEPGAGLQLLTYIFSNMDMKQ DQRLTVLLNKKDKHLSLRIADTQTGDSAIYFCAVPSGATNKLIFGTGTLLAVQPNIQNP DPAVYQLRDSKSSDKSVCLFTDFDSQTNVSQSKDSDVYITDKCVLDMRSMDFKSNSA VAWSNKSDFACANAFNNSIIPEDTFFPSPESSCDVKLVEKSFETDTNLNFQNLSVIGFRI LLLKVAGFNLLMTLRLWSS | TCR 12/TCR 55-(E7)11 alpha Cysteine-modified *Homo sapiens* (aa) |
| 285 | EPEVTQTPSHQVTQMGQEVILRCVPISNHLYFYWYRQILGQKVEFLVSFYNNEISEKSE IFDDQFSVERPDGSNFTLKIRSTKLEDSAMYFCASTTRSSYEQYFGPGTRLTVTEDLKN VFPPEVAVFEPSEAEISHTQKATLVCLATGFYPDHVELSWWVNGKEVHSGVSTDPQPL KEQPALNDSRYCLSSRLRVSATFWQNPRNHFRCQVQFYGLSENDEWTQDRAKPVTQI VSAEAWGRADCGFTSESYQQGVLSATILYEILLGKATLYAVLVSALVLMAMVKRKDS RG | TCR 6, TCR 12, TCR 55 - (E7)11 beta Native *Homo sapiens* (aa) |
| 286 | EPEVTQTPSHQVTQMGQEVILRCVPISNHLYFYWYRQILGQKVEFLVSFYNNEISEKSE IFDDQFSVERPDGSNFTLKIRSTKLEDSAMYFCASTTRSSYEQYFGPGTRLTVTEDLKN VFPPEVAVFEPSEAEISHTQKATLVCLATGFYPDHVELSWWVNGKEVHSGVCTDPQP LKEQPALNDSRYCLSSRLRVSATFWQNPRNHFRCQVQFYGLSENDEWTQDRAKPVT QIVSAEAWGRADCGFTSESYQQGVLSATILYEILLGKATLYAVLVSALVLMAMVKRK DSRG | TCR 6, TCR 12, TCR 55 - (E7)11 beta Cysteine-modified *Homo sapiens* (aa) |
| 287 | AQSVTQLDSHVSVSEGTPVLLRCNYSSSYSPSLFWYVQHPNKGLQLLLKYTSAATLV KGINGFEAEFKKSETSFHLTKPSAHMSDAAEYFCVVRGGKLIFGQGTELSVKPNIQNP DPAVYQLRDSKSSDKSVCLFTDFDSQTNVSQSKDSDVYITDKTVLDMRSMDFKSNSA VAWSNKSDFACANAFNNSIIPEDTFFPSPESSCDVKLVEKSFETDTNLNFQNLSVIGFRI LLLKVAGFNLLMTLRLWSS | TCR 13 - alpha Native *Homo sapiens* (aa) |
| 288 | AQSVTQLDSHVSVSEGTPVLLRCNYSSSYSPSLFWYVQHPNKGLQLLLKYTSAATLV KGINGFEAEFKKSETSFHLTKPSAHMSDAAEYFCVVRGGKLIFGQGTELSVKPNIQNP DPAVYQLRDSKSSDKSVCLFTDFDSQTNVSQSKDSDVYITDKCVLDMRSMDFKSNSA VAWSNKSDFACANAFNNSIIPEDTFFPSPESSCDVKLVEKSFETDTNLNFQNLSVIGFRI LLLKVAGFNLLMTLRLWSS | TCR 13 - alpha Cysteine-modified *Homo sapiens* (aa) |
| 289 | GAGVSQSPRYKVAKRGQDVALRCDPISGHVSLFWYQQALGQGPEFLTYFQNEAQLD KSGLPSDRFFAERPEGSVSTLKIQRTQQEDSAVYLCASSPTGTERELFFGEGSRLTVLE DLKNVFPPEVAVFEPSEAEISHTQKATLVCLATGFYPDHVELSWWVNGKEVHSGVST DPQPLKEQPALNDSRYCLSSRLRVSATFWQNPRNHFRCQVQFYGLSENDEWTQDRAK PVTQIVSAEAWGRADCGFTSESYQQGVLSATILYEILLGKATLYAVLVSALVLMAMV KRKDSRG | TCR 13 - beta native *Homo sapiens* |
| 290 | GAGVSQSPRYKVAKRGQDVALRCDPISGHVSLFWYQQALGQGPEFLTYFQNEAQLD KSGLPSDRFFAERPEGSVSTLKIQRTQQEDSAVYLCASSPTGTERELFFGEGSRLTVLE DLKNVFPPEVAVFEPSEAEISHTQKATLVCLATGFYPDHVELSWWVNGKEVHSGVCT DPQPLKEQPALNDSRYCLSSRLRVSATFWQNPRNHFRCQVQFYGLSENDEWTQDRAK PVTQIVSAEAWGRADCGFTSESYQQGVLSATILYEILLGKATLYAVLVSALVLMAMV KRKDSRG | TCR 13 - beta Cysteine-modified *Homo sapiens* (aa) |
| 291 | ILNVEQSPQSLHVQEGDSTNFTCSFPSSNFYALHWYRWETAKSPEALFVMTLNGDEK KKGRISATLNTKEGYSYLYIKGSQPEDSATYLCASQTGANNLFFGTGTRLTVIPYIQNP DPAVYQLRDSKSSDKSVCLFTDFDSQTNVSQSKDSDVYITDKTVLDMRSMDFKSNSA VAWSNKSDFACANAFNNSIIPEDTFFPSPESSCDVKLVEKSFETDTNLNFQNLSVIGFRI LLLKVAGFNLLMTLRLWSS | TCR 14 - alpha native *Homo sapiens* (aa) |
| 292 | ILNVEQSPQSLHVQEGDSTNFTCSFPSSNFYALHWYRWETAKSPEALFVMTLNGDEK KKGRISATLNTKEGYSYLYIKGSQPEDSATYLCASQTGANNLFFGTGTRLTVIPYIQNP DPAVYQLRDSKSSDKSVCLFTDFDSQTNVSQSKDSDVYITDKCVLDMRSMDFKSNSA VAWSNKSDFACANAFNNSIIPEDTFFPSPESSCDVKLVEKSFETDTNLNFQNLSVIGFRI LLLKVAGFNLLMTLRLWSS | TCR 14 - alpha Cysteine-modified *Homo sapiens* (aa) |

-continued

| SEQUENCE TABLE | | |
|---|---|---|
| SEQ ID NO. | SEQUENCE | DESCRIPTION |
| 293 | DVKVTQSSRYLVKRTGEKVFLECVQDMDHENMFWYRQDPGLGLRLIYFSYDVKMK EKGDIPEGYSVSREKKERFSLILESASTNQTSMYLCASTFWGQRRTEAFFGQGTRLTV VEDLNKVFPPEVAVFEPSEAEISHTQKATLVCLATGFFPDHVELSWWVNGKEVHSGV STDPQPLKEQPALNDSRYCLSSRLRVSATFWQNPRNHFRCQVQFYGLSENDEWTQDR AKPVTQIVSAEAWGRADCGFTSVSYQQGVLSATILYEILLGKATLYAVLVSALVLMA MVKRKDF | TCR 14 - beta native Homo sapiens (aa) |
| 294 | DVKVTQSSRYLVKRTGEKVFLECVQDMDHENMFWYRQDPGLGLRLIYFSYDVKMK EKGDIPEGYSVSREKKERFSLILESASTNQTSMYLCASTFWGQRRTEAFFGQGTRLTV VEDLNKVFPPEVAVFEPSEAEISHTQKATLVCLATGFFPDHVELSWWVNGKEVHSGV CTDPQPLKEQPALNDSRYCLSSRLRVSATFWQNPRNHFRCQVQFYGLSENDEWTQDR AKPVTQIVSAEAWGRADCGFTSVSYQQGVLSATILYEILLGKATLYAVLVSALVLMA MVKRKDF | TCR 14 - beta Cysteine-modified Homo sapiens (aa) |
| 295 | GEDVEQSLFLSVREGDSSVINCTYTDSSSTYLYWYKQEPGAGLQLLTYIFSNMDMKQ DQRLTVLLNKKDKHLSLRIADTQTGDSAIYFCAVPSGATNKLIFGTGTLLAVQP | TCR 12/TCR 55- alpha variable Homo sapiens (aa) |
| 296 | EPEVTQTPSHQVTQMGQEVILRCVPISNHLYFYWYRQILGQKVEFLVSFYNNEISEKSE IFDDQFSVERPDGSNFTLKIRSTKLEDSAMYFCASTTRSSYEQYFGPGTRLTVT | TCR 6, TCR 12, TCR 55 - beta variable Homo sapiens (aa) |
| 297 | AQSVTQLDSHVSVSEGTPVLLRCNYSSSYSPSLFWYVQHPNKGLQLLLKYTSAATLV KGINGFEAEFKKSETSFHLTKPSAHMSDAAEYFCVVRGGKLIFGQGTELSVKP | TCR 13 - alpha variable Homo sapiens (aa) |
| 298 | GAGVSQSPRYKVAKRGQDVALRCDPISGHVSLFWYQQALGQGPEFLTYFQNEAQLD KSGLPSDRFFAERPEGSVSTLKIQRTQQEDSAVYLCASSPTGTERELFFGEGSRLTVL | TCR 13 - beta variable Homo sapiens (aa) |
| 299 | ILNVEQSPQSLHVQEGDSTNFTCSFPSSNFYALHWYRWETAKSPEALFVMTLNGDEK KKGRISATLNTKEGYSYLYIKGSQPEDSATYLCASQTGANNLFFGTGTRLTVIP | TCR 14 - alpha variable Homo sapiens (aa) |
| 300 | DVKVTQSSRYLVKRTGEKVFLECVQDMDHENMFWYRQDPGLGLRLIYFSYDVKMK EKGDIPEGYSVSREKKERFSLILESASTNQTSMYLCASTFWGQRRTEAFFGQGTRLTV V | TCR 14 - beta variable Homo sapiens (aa) |
| 301 | AVPSGATNKLI | TCR 12/TCR 55 CDR3 alpha Homo sapiens (aa) |
| 302 | SSYSPS | TCR 13 CDR1 alpha Homo sapiens (aa) |
| 303 | YTSAATLV | TCR 13 CDR2 alpha Homo sapiens (aa) |
| 304 | VVRGGKLI | TCR 13 CDR3 alpha Homo sapiens (aa) |
| 305 | ASSPTGTERELF | TCR 13 CDR3 beta Homo sapiens (aa) |

| SEQ ID NO. | SEQUENCE | DESCRIPTION |
|---|---|---|
| 306 | SSNFYA | TCR 14 CDR1 alpha *Homo sapiens* (aa) |
| 307 | MTLNGDE | TCR 14 CDR2 alpha *Homo sapiens* (aa) |
| 308 | ASQTGANNLF | TCR 14 CDR3 alpha *Homo sapiens* (aa) |
| 309 | ASTFWGQRRTEAF | TCR 14 CDR3 beta *Homo sapiens* (aa) |
| 310 | MLLLLVPVLEVIFTLGGTR | TCR 13 alpha Signal sequence *Homo sapiens* (aa) |
| 311 | MEKNPLAAPLLILWFHLDCVSS | TCR 14 alpha Signal sequence *Homo sapiens* (aa) |
| 312 | MGTRLLCWVVLGFLGTDHTGAGVSQSPRYKVAKRGQDVALRCDPISGHVSLFWYQQ ALGQGPEFLTYFQNEAQLDKSGLPSDRFFAERPEGSVSTLKIQRTQQEDSAVYLCASSP TGTERELFFGEGSRLTVLEDLKNVFPPEVAVFEPSEAEISHTQKATLVCLATGFYPDHV ELSWWVNGKEVHSGVCTDPQPLKEQPALNDSRYCLSSRLRVSATFWQNPRNHFRCQ VQFYGLSENDEWTQDRAKPVTQIVSAEAWGRADCGFTSESYQQGVLSATILYEILLG KATLYAVLVSALVLMAMVKRKDSRG | TCR 13 - Beta Cysteine-modified *Homo sapiens* (aa) |
| 313 | MEKNPLAAPLLILWFHLDCVSSILNVEQSPQSLHVQEGDSTNFTCSFPSSNFYALHWY RWETAKSPEALFVMTLNGDEKKKGRISATLNTKEGYSYLYIKGSQPEDSATYLCASQT GANNLFFGTGTRLTVIPYIQNPDPAVYQLRDSKSSDKSVCLFTDFDSQTNVSQSKDSD VYITDKTVLDMRSMDFKSNSAVAWSNKSDFACANAFNNSIIPEDTFFPSPESSCDVKL VEKSFETDTNLNFQNLSVIGFRILLLKVAGFNLLMTLRLWSS | TCR 14 - Alpha Native *Homo sapiens* (aa) |
| 314 | MEKNPLAAPLLILWFHLDCVSSILNVEQSPQSLHVQEGDSTNFTCSFPSSNFYALHWY RWETAKSPEALFVMTLNGDEKKKGRISATLNTKEGYSYLYIKGSQPEDSATYLCASQT GANNLFFGTGTRLTVIPYIQNPDPAVYQLRDSKSSDKSVCLFTDFDSQTNVSQSKDSD VYITDKCVLDMRSMDFKSNSAVAWSNKSDFACANAFNNSIIPEDTFFPSPESSCDVKL VEKSFETDTNLNFQNLSVIGFRILLLKVAGFNLLMTLRLWSS | TCR 14 - Alpha Cysteine-modified *Homo sapiens* (aa) |
| 315 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASTF WGQRRTEAFFGQGTRLTVVEDLNKVFPPEVAVFEPSEAEISHTQKATLVCLATGFFPD HVELSWWVNGKEVHSGVSTDPQPLKEQPALNDSRYCLSSRLRVSATFWQNPRNHFR CQVQFYGLSENDEWTQDRAKPVTQIVSAEAWGRADCGFTSVSYQQGVLSATILYEIL LGKATLYAVLVSALVLMAMVKRKDF | TCR 14 - Beta Native *Homo sapiens* (aa) |
| 316 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASTF WGQRRTEAFFGQGTRLTVVEDLNKVFPPEVAVFEPSEAEISHTQKATLVCLATGFFPD HVELSWWVNGKEVHSGVCTDPQPLKEQPALNDSRYCLSSRLRVSATFWQNPRNHFR CQVQFYGLSENDEWTQDRAKPVTQIVSAEAWGRADCGFTSVSYQQGVLSATILYEIL LGKATLYAVLVSALVLMAMVKRKDF | TCR 14 - Beta Cysteine-modified *Homo sapiens* (aa) |
| 317 | NIQNPEPAVYQLKDPRSQDSTLCLFTDFDSQINVPKTMESGTFITDKTVLDMKAMDSK SNGAIAWSNQTSFTCQDIFKETNATYPSSDVPCDATLTEKSFETDMNLNFQNLSVMGL RILLLKVAGFNLLMTLRLWSS | Mouse Alpha Constant Sequence *Mus musculus* (aa) |

| SEQ ID NO. | SEQUENCE | DESCRIPTION |
|---|---|---|
| 318 | MSLSSLLKVVTASLWLGPGIAQKITQTQPGMFVQEKEAVTLDCTYDTSDQSYGLFWY KQPSSGEMIFLIYQGSYDEQNATEGRYSLNFQKARKSANLVISASQLGDSAMYFCAM REGRGFKTIFGAGTRLFVKANIQKPDPAVYQLRDSKSSDKSVCLFTDFDSQTNVSQSK DSDVYITDKTVLDMRSMDFKSNSAVAWSNKSDFACANAFNNSIIPADTFFPSPESSCD VKLVEKSFETDTNLNFQNLSVIGFRILLLKVAGFNLLMTLRLWSS | TCR 3 - Alpha Native *Homo sapiens* (aa) |
| 319 | MSLSSLLKVVTASLWLGPGIAQKITQTQPGMFVQEKEAVTLDCTYDTSDQSYGLFWY KQPSSGEMIFLIYQGSYDEQNATEGRYSLNFQKARKSANLVISASQLGDSAMYFCAM REGRGFKTIFGAGTRLFVKANIQKPDPAVYQLRDSKSSDKSVCLFTDFDSQTNVSQSK DSDVYITDKCVLDMRSMDFKSNSAVAWSNKSDFACANAFNNSIIPADTFFPSPESSCD VKLVEKSFETDTNLNFQNLSVIGFRILLLKVAGFNLLMTLRLWSS | TCR 3 - Alpha Cysteine-modified *Homo sapiens* (aa) |
| 320 | MGTRLLCWVVLGFLGTDHTGAGVSQSPRYKVAKRGQDVALRCDPISGHVSLFWYQQ ALGQGPEFLTYFQNEAQLDKSGLPSDRFFAERPEGSVSTLKIQRTQQEDSAVYLCASS HLAGFTGELFFGEGSRLTVLEDLKNVFPPEVAVFEPSEAEISHTQKATLVCLATGFYPD HVELSWWVNGKEVHSGVSTDPQPLKEQPALNDSRYCLSSRLRVSATFWQNPRNHFR CQVQFYGLSENDEWTQDRAKPVTQIVSAEAWGRADCGFTSESYQQGVLSATILYEILL GKATLYAVLVSALVLMAMVKRKDSRG | TCR 3 - Beta Native *Homo sapiens* (aa) |
| 321 | MGTRLLCWVVLGFLGTDHTGAGVSQSPRYKVAKRGQDVALRCDPISGHVSLFWYQQ ALGQGPEFLTYFQNEAQLDKSGLPSDRFFAERPEGSVSTLKIQRTQQEDSAVYLCASS HLAGFTGELFFGEGSRLTVLEDLKNVFPPEVAVFEPSEAEISHTQKATLVCLATGFYPD HVELSWWVNGKEVHSGVCTDPQPLKEQPALNDSRYCLSSRLRVSATFWQNPRNHFR CQVQFYGLSENDEWTQDRAKPVTQIVSAEAWGRADCGFTSESYQQGVLSATILYEILL GKATLYAVLVSALVLMAMVKRKDSRG | TCR 3 - Beta Cysteine-modified *Homo sapiens* (aa) |
| 322 | MKLVTSITVLLSLGIMGDAKTTQPNSMESNEEEPVHLPCNHSTISGTDYIHWYRQLPSQ GPEYVIHGLTSNVNNRMASLAIAEDRKSSTLILHRATLRDAAVYYCILLVIRGTSYGKL TFGQGTILTVHPNIQNPDPAVYQLRDSKSSDKSVCLFTDFDSQTNVSQSKDSDVYITDK TVLDMRSMDFKSNSAVAWSNKSDFACANAFNNSIIPEDTFFPSPESSCDVKLVEKSFET DTNLNFQNLSVIGFRILLLKVAGFNLLMTLRLWSS | TCR 4 - (E6)29 alpha Native *Homo sapiens* (aa) |
| 323 | MKLVTSITVLLSLGIMGDAKTTQPNSMESNEEEPVHLPCNHSTISGTDYIHWYRQLPSQ GPEYVIHGLTSNVNNRMASLAIAEDRKSSTLILHRATLRDAAVYYCILLVIRGTSYGKL TFGQGTILTVHPNIQNPDPAVYQLRDSKSSDKSVCLFTDFDSQTNVSQSKDSDVYITDK CVLDMRSMDFKSNSAVAWSNKSDFACANAFNNSIIPEDTFFPSPESSCDVKLVEKSFE TDTNLNFQNLSVIGFRILLLKVAGFNLLMTLRLWSS | TCR 4 - (E6)29 alpha Cysteine-modified *Homo sapiens* (aa) |
| 324 | MGTSLLCWMALCLLGADHADTGVSQDPRHKITKRGQNVTFRCDPISEHNRLYWYRQ TLGQGPEFLTYFQNEAQLEKSRLLSDRFSAERPKGSFSTLEIQRTEQGDSAMYLCASSP GGGNTEAFFGQGTRLTVVEDLNKVFPPEVAVFEPSEAEISHTQKATLVCLATGFFPDH VELSWWVNGKEVHSGVSTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDF | TCR 4 - (E6)29 Beta Native *Homo sapiens* (aa) |
| 325 | MGTSLLCWMALCLLGADHADTGVSQDPRHKITKRGQNVTFRCDPISEHNRLYWYRQ TLGQGPEFLTYFQNEAQLEKSRLLSDRFSAERPKGSFSTLEIQRTEQGDSAMYLCASSP GGGNTEAFFGQGTRLTVVEDLNKVFPPEVAVFEPSEAEISHTQKATLVCLATGFFPDH VELSWWVNGKEVHSGVCTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDF | TCR 4 - (E6)29 Beta Cysteine-modified *Homo sapiens* (aa) |
| 326 | MSLSSLLKVVTASLWLGPGIAQKITQTQPGMFVQEKEAVTLDCTYDTSDQSYGLFWY KQPSSGEMIFLIYQGSYDEQNATEGRYSLNFQKARKSANLVISASQLGDSAMYFCAM REGTGTSYGKLTFGQGTILTVHPNIQNPDPAVYQLRDSKSSDKSVCLFTDFDSQTNVS QSKDSDVYITDKTVLDMRSMDFKSNSAVAWSNKSDFACANAFNNSIIPEDTFFPSPESS CDVKLVEKSFETDTNLNFQNLSVIGFRILLLKVAGFNLLMTLRLWSS | TCR 5 - (E6)29 - TCR alpha Native *Homo sapiens* (aa) |
| 327 | MSLSSLLKVVTASLWLGPGIAQKITQTQPGMFVQEKEAVTLDCTYDTSDQSYGLFWY KQPSSGEMIFLIYQGSYDEQNATEGRYSLNFQKARKSANLVISASQLGDSAMYFCAM REGTGTSYGKLTFGQGTILTVHPNIQNPDPAVYQLRDSKSSDKSVCLFTDFDSQTNVS QSKDSDVYITDKCVLDMRSMDFKSNSAVAWSNKSDFACANAFNNSIIPEDTFFPSPES SCDVKLVEKSFETDTNLNFQNLSVIGFRILLLKVAGFNLLMTLRLWSS | TCR 5 - (E6)29 - TCR alpha Cysteine-modified *Homo sapiens* (aa) |
| 328 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASSP WGETHQPQHFGDGTRLSILEDLNKVFPPEVAVFEPSEAEISHTQKATLVCLATGFFPDH VELSWWVNGKEVHSGVSTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDF | TCR 5 - (E6)29 - TCR beta Native *Homo sapiens* (aa) |

-continued

| SEQ ID NO. | SEQUENCE | DESCRIPTION |
|---|---|---|
| 329 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASSP WGETHQPQHFGDGTRLSILEDLNKVFPPEVAVFEPSEAEISHTQKATLVCLATGFFPDH VELSWWVNGKEVHSGVCTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDF | TCR 5 - (E6)29 - TCR beta Cysteine-modified *Homo sapiens* (aa) |
| 330 | MKTFAGFSFLFLWLQLDCMSRGEDVEQSLFLSVREGDSSVINCTYTDSSSTYLYWYK QEPGAGLQLLTYIFSNMDMKQDQRLTVLLNKKDKHLSLRIADTQTGDSAIYFCAESIR GFGNVLHCGSGTQVIVLPHIQNPDPAVYQLRDSKSSDKSVCLFTDFDSQTNVSQSKDS DVYITDKTVLDMRSMDFKSNSAVAWSNKSDFACANAFNNSIIPEDTFFPSPESSCDVK LVEKSFETDTNLNFQNLSVIGFRILLLKVAGFNLLMTLRLWSS | TCR 6 - Alpha Native *Homo sapiens* (aa) |
| 331 | MKTFAGFSFLFLWLQLDCMSRGEDVEQSLFLSVREGDSSVINCTYTDSSSTYLYWYK QEPGAGLQLLTYIFSNMDMKQDQRLTVLLNKKDKHLSLRIADTQTGDSAIYFCAESIR GFGNVLHCGSGTQVIVLPHIQNPDPAVYQLRDSKSSDKSVCLFTDFDSQTNVSQSKDS DVYITDKCVLDMRSMDFKSNSAVAWSNKSDFACANAFNNSIIPEDTFFPSPESSCDVK LVEKSFETDTNLNFQNLSVIGFRILLLKVAGFNLLMTLRLWSS | TCR 6 - Alpha Cysteine-modified *Homo sapiens* (aa) |
| 332 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCASTTRS SYEQYFGPGTRLTVTEDLKNVFPPEVAVFEPSEAEISHTQKATLVCLATGFYPDHVELS WWVNGKEVHSGVSTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRG | TCR 6, TCR 12 - Beta Native *Homo sapiens* (aa) |
| 333 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCASTTRS SYEQYFGPGTRLTVTEDLKNVFPPEVAVFEPSEAEISHTQKATLVCLATGFYPDHVELS WWVNGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRG | TCR 6, TCR 12 - Beta Cysteine-modified *Homo sapiens* (aa) |
| 334 | MKKHLTTFLVILWLYFYRGNGKNQVEQSPQSLIILEGKNCTLQCNYTVSPFSNLRWYK QDTGRGPVSLTIMTFSENTKSNGRYTATLDADTKQSSLHITASQLSDSASYICVVSRDN YGQNFVFGPGTRLSVLPYIQNPDPAVYQLRDSKSSDKSVCLFTDFDSQTNVSQSKDSD VYITDKTVLDMRSMDFKSNSAVAWSNKSDFACANAFNNSIIPEDTFFPSPESSCDVKL VEKSFETDTNLNFQNLSVIGFRILLLKVAGFNLLMTLRLWSS | TCR 7/TCR 54-(E7)11 - alpha Native *Homo sapiens* (aa) |
| 335 | MKKHLTTFLVILWLYFYRGNGKNQVEQSPQSLIILEGKNCTLQCNYTVSPFSNLRWYK QDTGRGPVSLTIMTFSENTKSNGRYTATLDADTKQSSLHITASQLSDSASYICVVSRDN YGQNFVFGPGTRLSVLPYIQNPDPAVYQLRDSKSSDKSVCLFTDFDSQTNVSQSKDSD VYITDKCVLDMRSMDFKSNSAVAWSNKSDFACANAFNNSIIPEDTFFPSPESSCDVKL VEKSFETDTNLNFQNLSVIGFRILLLKVAGFNLLMTLRLWSS | TCR 7/TCR 54 - (E7)11 - alpha Cysteine-modified *Homo sapiens* (aa) |
| 336 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCAITDRT NYGYTFGSGTRLTVVEDLNKVFPPEVAVFEPSEAEISHTQKATLVCLATGFFPDHVELS WWVNGKEVHSGVSTDPQPLKEQPALNDSRYCLSSRLRVSATFWQNPRNHFRCQVQF YGLSENDEWTQDRAKPVTQIVSAEAWGRADCGFTSVSYQQGVLSATILYEILLGKAT LYAVLVSALVLMAMVKRKDF | TCR 7/TCR 54-(E7)11 -Beta Native *Homo sapiens* (aa) |
| 337 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCAITDRT NYGYTFGSGTRLTVVEDLNKVFPPEVAVFEPSEAEISHTQKATLVCLATGFFPDHVELS WWVNGKEVHSGVCTDPQPLKEQPALNDSRYCLSSRLRVSATFWQNPRNHFRCQVQF YGLSENDEWTQDRAKPVTQIVSAEAWGRADCGFTSVSYQQGVLSATILYEILLGKAT LYAVLVSALVLMAMVKRKDF | TCR 7/TCR 54-(E7)11 -Beta Cysteine-modified *Homo sapiens* (aa) |
| 338 | METLLGLLILWLQLQWVSSKQEVTQIPAALSVPEGENLVLNCSFTDSAIYNLQWFRQD PGKGLTSLLLIQSSQREQTSGRLNASLDKSSGRSTLYIAASQPGDSATYLCAVRPLGNT PLVFGKGTRLSVIANIQNPDPAVYQLRDSKSSDKSVCLFTDFDSQTNVSQSKDSDVYIT DKTVLDMRSMDFKSNSAVAWSNKSDFACANAFNNSIIPEDTFFPSPESSCDVKLVEKS FETDTNLNFQNLSVIGFRILLLKVAGFNLLMTLRLWSS | TCR 8 - Alpha Native *Homo sapiens* (aa) |
| 339 | METLLGLLILWLQLQWVSSKQEVTQIPAALSVPEGENLVLNCSFTDSAIYNLQWFRQD PGKGLTSLLLIQSSQREQTSGRLNASLDKSSGRSTLYIAASQPGDSATYLCAVRPLGNT PLVFGKGTRLSVIANIQNPDPAVYQLRDSKSSDKSVCLFTDFDSQTNVSQSKDSDVYIT DKCVLDMRSMDFKSNSAVAWSNKSDFACANAFNNSIIPEDTFFPSPESSCDVKLVEKS FETDTNLNFQNLSVIGFRILLLKVAGFNLLMTLRLWSS | TCR 8 - Alpha Cysteine-modified *Homo sapiens* (aa) |

-continued

SEQUENCE TABLE

| SEQ ID NO. | SEQUENCE | DESCRIPTION |
|---|---|---|
| 340 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCASTTRS SYEQYFGPGTRLTVTEDLKNVFPPEVAVFEPSEAEISHTQKATLVCLATGFYPDHVELS WWVNGKEVHSGVSTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRGGSATNFSLLKQAGDVEENPGPMKTFAGFSFLFLW LQLDCMSRGEDVEQSLFLSVREGDSSVINCTYTDSSSTYLYWYKQEPGAGLQLLTYIF SNMDMKQDQRLTVLLNKKDKHLSLRIADTQTGDSAIYFCAVPSGATNKLIFGTGTLL AVQPNIQNPDPAVYQLRDSKSSDKSVCLFTDFDSQTNVSQSKDSDVYITDKTVLDMRS MDFKSNSAVAWSNKSDFACANAFNNSIIPEDTFFPSPESSCDVKLVEKSFETDTNLNFQ NLSVIGFRILLLKVAGFNLLMTLRLWSS | TCR 12/TCR 55 Full sequence Native Homo sapiens (aa) |
| 341 | MGTRLLCWVVLGFLGTDHTGAGVSQSPRYKVAKRGQDVALRCDPISGHVSLFWYQQ ALGQGPEFLTYFQNEAQLDKSGLPSDRFFAERPEGSVSTLKIQRTQQEDSAVYLCASSP TGTERELFFGEGSRLTVLEDLKNVFPPEVAVFEPSEAEISHTQKATLVCLATGFYPDHV ELSWWVNGKEVHSGVSTDPQPLKEQPALNDSRYCLSSRLRVSATFWQNPRNHFRCQ VQFYGLSENDEWTQDRAKPVTQIVSAEAWGRADCGFTSESYQQGVLSATILYEILLG KATLYAVLVSALVLMAMVKRKDSRGGSATNFSLLKQAGDVEENPGPMLLLLVPVL EVIFTLGGTRAQSVTQLDSHVSVSEGTPVLLRCNYSSSYSPSLFWYVQHPNKGLQLLL KYTSAATLVKGINGFEAEFKKSETSFHLTKPSAHMSDAAEYFCVVRGGKLIFGQGTEL SVKPNIQNPDPAVYQLRDSKSSDKSVCLFTDFDSQTNVSQSKDSDVYITDKTVLDMRS MDFKSNSAVAWSNKSDFACANAFNNSIIPEDTFFPSPESSCDVKLVEKSFETDTNLNFQ NLSVIGFRILLLKVAGFNLLMTLRLWSS | TCR 13 Full sequence Native Homo sapiens (aa) |
| 342 | MGIRLLCRVAFCFLAVGLVDVKVTQSSRYLVKRTGEKVFLECVQDMDHENMFWYR QDPGLGLRLIYFSYDVKMKEKGDIPEGYSVSREKKERFSLILESASTNQTSMYLCASTF WGQRRTEAFFGQGTRLTVLEDLKNVFPPEVAVFEPSEAEISHTQKATLVCLATGFYPD HVELSWWVNGKEVHSGVSTDPQPLKEQPALNDSRYCLSSRLRVSATFWQNPRNHFR CQVQFYGLSENDEWTQDRAKPVTQIVSAEAWGRADCGFTSVSYQQGVLSATILYEIL LGKATLYAVLVSALVLMAMVKRKDFGSGATNFSLLKQAGDVEENPGPMEKNPLAAP LLILWFHLDCVSSILNVEQSPQSLHVQEGDSTNFTCSFPSSNFYALHWYRWETAKSPE ALFVMTLNGDEKKKGRISATLNTKEGYSYLYIKGSQPEDSATYLCASQTGANNLFFGT GTRLTVIPYIQNPDPAVYQLRDSKSSDKSVCLFTDFDSQTNVSQSKDSDVYITDKTVLD MRSMDFKSNSAVAWSNKSDFACANAFNNSIIPEDTFFPSPESSCDVKLVEKSFETDTNL NFQNLSVIGFRILLLKVAGFNLLMTLRLWSS | TCR 14 Full sequence Native Homo sapiens (aa) |
| 343 | RKVCNGIGIGEFKDSLSINATNIKHFKNCTSISGDLHILPVAFRGDSFTHTPPLDPQELDI LKTVKEITGFLLIQAWPENRTDLHAFENLEIIRGRTKQHGQFSLAVVSLNITSLGLRSLK EISDGDVIISGNKNLCYANTINWKKLFGTSGQKTKIISNRGENSCKATGQVCHALCSPE GCWGPEPRDCVSCRNVSRGRECVDKCNLLEGEPREFVENSECIQCHPECLPQAMNITC TGRGPDNCIQCAHYIDGPHCVKTCPAGVMGENNTLVWKYADAGHVCHLCHPNCTY GCTGPGLEGCPTNGPKIPSIATGMVGALLLLLVVALGIGLFM | tEGFR artificial |
| 344 | VKQTLNFDLLKLAGDVESNPGP | F2A |
| 345 | ATNFSLLKQAGDVEENPGP | P2A |
| 346 | QCTNYALLKLAGDVESNPGP | E2A |
| 347 | ggaagcggcgccacaaacttctcactgctgaaacaggccggcgacgtggaggagaatcctggccca | TCR 49/TCR 51/ TCR 52/TCR 53/ TCR 55 -P2A Artificial (nt) |
| 348 | atatccagaaccctgaccctgccgtgtaccagctgagagactctaaatccagtgacaag tctgtctgcctattcaccgattttgattctcaaacaaatgtgtcacaaagtaaggattc tgatgtgtatatcacagacaaaactgtgctagacatgaggtctatggactcaagagca acagtgctgtggcctggagcaacaaatctgactttgcatgtgcaaacgccttcaacaac agcattattccagaagacaccttcttccccagcccaggtaagggcagctttggtgcctt cgcaggctgtttccttgcttcaggaatggccaggttctgcccagagctctggtcaatga tgtctaaaactcctctgattggtggtctcggccttatccattgccaccaaaaccctctt tttactaagaaacagtgagccttgttctgcagtccagagaagtgacacgggaaaaaagc agatgaagagaaggtggcaggagagggcacgtggcccagcctcagtctctccaactgag ttcctgcctgcctgccttgctcagactgtttgccccttactgctcttctaggcctcat tctaagcccttctccaagttgcctctccttatttctccctgtctgccaaaaaatcttt cccagctcactaagtcagtctcacgcagtcactcattaacccaccaatcactgattgtg ccggcacatgaatgcaccaggtgttgaagtggaggaattaaaaagtcagatgaggggtg tgcccagaggaagcaccattctagttggggagcccatctgtcagctgggaaaagtcca aataacttcagattggaatgtgttttaactcagggttgagaaaacagctaccttcagga caaaagtcagggaagggctctctgaagaaatgctacttgaagataccagccctaccaag ggcagggagaggaccctatagaggcctgggacaggagctcaatgagaaggagaagagc agcaggcatgagttgaatgaaggaggcagggccgggtcacagggccttctaggccatga | Human TCR alpha constant (TRAC) NCBI Reference Sequence: NG_001332.3, TRAC |

| SEQ ID NO. | SEQUENCE | DESCRIPTION |
|---|---|---|
| | gagggtagacagtattctaaggacgccagaaagctgttgatcggcttcaagcaggggag<br>ggacacctaatttgcttttcttttttttttttttttttttttttttttgagatggag<br>ttttgctcttgttgcccaggctggagtgcaatggtgcatcttggctcactgcaacctcc<br>gcctcccaggttcaagtgattctcctgcctcagcctcccgagtagctgagattacaggc<br>acccgccaccatgcctggctaattttttgtattttagtagagacagggtttcactatg<br>ttggccaggctggtctcgaactcctgacctcaggtgatccacccgcttcagcctcccaa<br>agtgctgggattacaggcgtgagccaccacacccggcctgcttttcttaaagatcaatc<br>tgagtgctgtacggagagtgggttgtaagcaagagtagaagcagaaagggagcagttg<br>cagcagagagatgatggaggcctgggcagggtggtggcagggaggtaaccaacaccatt<br>caggtttcaaaggtagaaccatgcagggatgagaaagcaaagaggggatcaaggaaggc<br>agctggattttggcctgagcagctgagtcaatgatagtgccgtttactaagaagaaacc<br>aaggaaaaaatttggggtgcagggatcaaaacttttttggaacatatgaaagtacgtgtt<br>tatactctttatggcccttgtcactatgtatgcctcgctgcctccattggactctagaa<br>tgaagccaggcaagagcagggtctatgtgtgatggcacatgtggccagggtcatgcaac<br>atgtactttgtacaaacagtgtatattgagtaaatagaaatggtgtccaggagccgagg<br>tatcggtcctgccagggccaggggctctccctagcaggtgctcatatgctgtaagttcc<br>ctccagatctctccacaaggaggcatgaaaggctgtagttgttcacctgcccaagaac<br>taggaggtctgggtgggagagtcagcctgctctggatgctgaaagaatgtctgttttt<br>ccttttagaaagttcctgtgatgtcaagctggtcgagaaaagctttgaaacaggtaaga<br>caggggtctagcctgggtttgcacaggattgcggaagtgatgaaccccgcaataaccctg<br>cctgatgagggagtgggaagaaattagtagatgtgggaatgaatgatgaggaatggaa<br>acagcggttcaagacctgcccagagctgggtggggtctctcctgaatccctctcaccat<br>ctctgactttccattctaagcactttgaggatgagtttctagcttcaatagaccaagga<br>ctctctcctaggcctctgtattcctttcaacagctccactgtcaagagagccagagaga<br>gcttctgggtggcccagctgtgaaatttctgagtccccttagggatagccctaaacgaac<br>cagatcatcctgaggacagccaagaggttttgccttcttcaagacaagcaacagtact<br>cacataggctgtgggcaatggtcctgtctctcaagaatcccctgccactcctcacaccc<br>accctgggcccatattcatttccatttgagttgttcttattgagtcatcctcctgtgg<br>tagcggaactcactaaggggcccatctggacccgaggtattgtgatgataaattctgag<br>cacctaccccatcccagaagggctcagaaataaaataagagccaagtctagtcggtgt<br>ttcctgtcttgaaacacaatactgttggccctggaagaatgcacagaatctgtttgtaa<br>ggggatatgcacagaagctgcaagggacaggaggtgcaggagctgcaggcctcccccac<br>ccagcctgctctgccttgggaaaaccgtgggtgtgtcctgcaggccatgcaggcctgg<br>gacatgcaagcccataaccgctgtggcctcttggttttacagatacgaacctaaacttt<br>caaaacctgtcagtgattgggttccgaatcctcctcctgaaagtggccgggtttaatct<br>gctcatgacgctgcggctgtggtccagctgaggtgaggggccttgaagctgggagtggg<br>gtttagggacgcgggtctctgggtgcatcctaagctctgagagcaaacctccctgcagg<br>gtcttgcttttaagtccaaagcctgagcccaccaaactctcctacttcttcctgttaca<br>aattcctcttgtgcaataataatggcctgaaacgctgtaaaatatcctcatttcagccg<br>cctcagttgcacttctccccctatgaggtaggaagaacagttgtttagaaacgaagaaac<br>tgaggccccacacgctaatgagtggaggaagagagacacttgtgtacaccacatgcctg<br>tgttgtacttctctcaccgtgtaacctcctcatgtcctctctcccagtacggctctct<br>tagctcagtagaaagaagacattacactcatattacaccccaatcctggctagagtctc<br>cgcaccctcctccccaagggtccccagtcgtcttgctgacaactgcatcctgttccatc<br>accatcaaaaaaaaactccaggctgggtgcgggggctcacacctgtaatcccagcactt<br>tgggaggcagaggcaggaggagcacaggagctggagaccagcctgggcaacacagggag<br>accccgcctctacaaaaagtgaaaaaattaaccaggtgtggtgctgcacacctgtagtc<br>ccagctacttaagaggctgagatggaggatcgcttgagccctggaatgttgaggctac<br>aatgagctgtgattgcgtcactgcactccagcctggaagacaaagcaagatcctgtctc<br>aaataataaaaaaaataagaactccagggtacatttgctcctagaactctaccacatag<br>ccccaaacagagccatcaccatcacatccctaacagtcctgggtcttcctcagtgtcca<br>gcctgacttctgttcttcctcattccagatctgcaagattgtaagacagcctgtgctcc<br>ctcgctccttcctctgcattgccctcttctccctctccaaacagagggaactctccta<br>ccccaaggaggtgaaagctgctaccacctctgtgccccccggcaatgccaccaactg<br>gatcctacccgaatttatgattaagattgctgaagagctgccaaaacactgctgccaccc<br>cctctgttcccttattgctgcttgtcactgcctgacattcacggcagaggcaaggctgc<br>tgcagcctcccctggctgtgcacattccctcctgctcccagagactgcctccgccatc<br>ccacagatgatgatcttcagtgggttctcttgggctctaggtcctgcagaatgttgtg<br>aggggtttattttttttaatagtgttcataaagaaatacatagtattcttcttctcaa<br>gacgtgggggaaattatctcattatcgaggccctgctatgctgtgtatctgggcgtgt<br>tgtatgtcctgctgccgatgccttc | |
| 349 | aggacctgaacaaggtgttcccacccgaggtcgctgtgtttgagccatcagaagca<br>gagatctcccacacccaaaaggccacactggtgtgcctggccacaggcttcttcccga<br>ccacgtggagctgagctggtgggtgaatgggaaggaggtgcacagtggggtcagcacag<br>acccgcagcccctcaaggagcagcccgcctcaatgactccagatactgcctgagcagc<br>cgcctgagggtctcggccaccttctggcagaaccccgcaaccacttccgctgtcaagt<br>ccagttctacgggctctcggagaatgacgagtgaccaggataggggccaaacccgtc<br>acccagatcgtcagcgccgaggcctgggtagagcaggtgagtggggcctggggagat<br>gcctggaggagattaggtgagaccagctaccagggaaaatggaaagatccaggtagca<br>gacaagactgatccaaaaagaaaggaaccagcgcacaccatgaaggagaattgggca<br>cctgtggttcattcttctcccagattctcagcccaacagagccaagcagctgggtccc<br>cttctatgtggcctgtgtaactctcatctgggtggtgcccccatcccccctcagtgc | Human TCR beta constant 1 (TRBC1) NCBI Reference Sequence: NG_001333.2, TRBC1 |

-continued

| SEQ ID NO. | SEQUENCE | DESCRIPTION |
|---|---|---|
| | tgccacatgccatggattgcaaggacaatgtggctgacatctgcatggcagaagaaag<br>gaggtgctggctgtcagaggaagctggtctgggcctgggagtctgtgccaactgcaa<br>atctgacttttaattgcctatgaaaataaggtctctcatttatttttcctctcc<br>ctgctttctttcagactgtgcttaccctcgggtaagtaagcccttccttttcctctc<br>cctctctcatggttcttgacctagaaccaaggcatgaagaactcacagacactggagg<br>gtggaggggagagaccagagctacctgtgcacaggtacccacctgtccttcctccg<br>tgccaacagtgtcctaccagcaaggggtcctgtctgccaccatcctctatgagatcct<br>gctagggaaggccaccctgtatgctgtgctggtcagcgcccttgtgttgatggccatg<br>gtaagcaggagggcaggatggggccagcaggctggaggtgacacactgacaccaagca<br>cccagaagtatagagtccctgccaggattggagctgggcagtagggagggaagagatt<br>tcattcaggtgcctcagaagataacttgcacctctgtaggatcacagtggaagggtca<br>tgctgggaaggaagctggagtcaccagaaaaaccaatggatgttgtgatgagccitt<br>actatttgtgtggtcaatgggccctactactttctctcaatcctcacaactcctggct<br>cttaataaccccccaaaacttttctcttctgcaggtcaagagaaaggatttctga | |
| 350 | MDSWTFCCVSLCILVAKHTDAGVIQSPRHEVTEMGQEVTLRCKPISGHNSLFWYRQT<br>MMRGLELLIYFNNNVPIDDSGMPEDRFSAKMPNASFSTLKIQPSEPRDSAVYFCASSLV<br>GRSRTEQYFGPGTRLTVTEDLKNVFPPEVAVFEPSEAEISHTQKATLVCLATGFYPDH<br>VELSWWVNGKEVHSGVCTDPQPLKEQPALNDSRYCLSSRLRVSATFWQNPRNHFRC<br>QVQFYGLSENDEWTQDRAKPVTQIVSAEAWGRADCGFTSESYQQGVLSATILYEILL<br>GKATLYAVLVSALVLMAMVKRKDSRGGSGATNFSLLKQAGDVEENPGPMSLSSLLK<br>VVTASLWLGPGIAQKITQTQPGMFVQEKEAVTLDCTYDTSDQSYGLFWYKQPSSGEM<br>IFLIYQGSYDEQNATEGRYSLNFQKARKSANLVISASQLGDSAMYFCAMKPGGYNKLI<br>FGAGTRLAVHPYIQNPDDPAVYQLRDSKSSDKSVCLFTDFDSQTNVSQSKDSDVYITDK<br>CVLDMRSMDFKSNSAVAWSNKSDFACANAFNNSIIPEDTFFPSPESSCDVKLVEKSFE<br>TDTNLNFQNLSVIGFRILLLKVAGFNLLMTLRLWSS | TCR 15<br>Full sequence<br>Cysteine-<br>modified<br>*Homo sapiens*<br>(aa) |
| 351 | MGIRLLCRVAFCFLAVGLVDVKVTQSSRYLVKRTGEKVFLECVQDMDHENMFWYR<br>QDPGLGLRLIYFSYDVKMKEKGDIPEGYSVSREKKERFSLILESASTNQTSMYLCASSL<br>WGRSNQPQHFGDGTRLSILEDLNKVFPPEVAVFEPSEAEISHTQKATLVCLATGFFPDH<br>VELSWWVNGKEVHSGVCTDPQPLKEQPALNDSRYCLSSRLRVSATFWQNPRNHFRC<br>QVQFYGLSENDEWTQDRAKPVTQIVSAEAWGRADCGFTSVSYQQGVLSATILYEILL<br>GKATLYAVLVSALVLMAMVKRKDFGSGATNFSLLKQAGDVEENPGPMETLLGLLIL<br>WLQLQWVSSKQEVTQIPAALSVPEGENLVLNCSFTDSAIYNLQWFRQDPGKGLTSLLL<br>IQSSQREQTSGRLNASLDKSSGRSTLYIAASQPGDSATYLCAVRPANNNDMRFGAGTR<br>LTVKPNIQNPDPAVYQLRDSKSSDKSVCLFTDFDSQTNVSQSKDSDVYITDKCVLDMR<br>SMDFKSNSAVAWSNKSDFACANAFNNSIIPEDTFFPSPESSCDVKLVEKSFETDTNLNF<br>QNLSVIGFRLLLKVAGFNLLMTLRLWSS | TCR 16<br>Full sequence<br>Cysteine-<br>modified<br>*Homo sapiens*<br>(aa) |
| 352 | MGIRLLCRVAFCFLAVGLVDVKVTQSSRYLVKRTGEKVFLECVQDMDHENMFWYR<br>QDPGLGLRLIYFSYDVKMKEKGDIPEGYSVSREKKERFSLILESASTNQTSMYLCASSL<br>WGRSNQPQHFGDGTRLSILEDLNKVFPPEVAVFEPSEAEISHTQKATLVCLATGFFPDH<br>VELSWWVNGKEVHSGVCTDPQPLKEQPALNDSRYCLSSRLRVSATFWQNPRNHFRC<br>QVQFYGLSENDEWTQDRAKPVTQIVSAEAWGRADCGFTSVSYQQGVLSATILYEILL<br>GKATLYAVLVSALVLMAMVKRKDFGSGATNFSLLKQAGDVEENPGPMSLSSLLKVV<br>TASLWLGPGIAQKITQTQPGMFVQEKEAVTLDCTYDTSDPSYGLFWYKQPSSGEMIFL<br>IYQGSYDQQNATEGRYSLNFQKARKSANLVISASQLGDSAMYFCAMREGRGDKIIFG<br>KGTRLHILPNIQNPDPAVYQLRDSKSSDKSVCLFTDFDSQTNVSQSKDSDVYITDKCVL<br>DMRSMDFKSNSAVAWSNKSDFACANAFNNSIIPEDTFFPSPESSCDVKLVEKSFETDT<br>NLNFQNLSVIGFRILLLKVAGFNLLMTLRLWSS | TCR 17<br>Full sequence<br>Cysteine-<br>modified<br>*Homo sapiens*<br>(aa) |
| 353 | MGIRLLCRVAFCFLAVGLVDVKVTQSSRYLVKRTGEKVFLECVQDMDHENMFWYR<br>QDPGLGLRLIYFSYDVKMKEKGDIPEGYSVSREKKERFSLILESASTNQTSMYLCASSF<br>WGRSNSPLHFGNGTRLTVTEDLKNVFPPEVAVFEPSEAEISHTQKATLVCLATGFFPD<br>HVELSWWVNGKEVHSGVCTDPQPLKEQPALNDSRYCLSSRLRVSATFWQNPRNHF<br>CQVQFYGLSENDEWTQDRAKPVTQIVSAEAWGRADCGFTSVSYQQGVLSATILYEIL<br>LGKATLYAVLVSALVLMAMVKRKDFGSGATNFSLLKQAGDVEENPGPMETLLGLLIL<br>WLQLQWVSSKQEVTQIPAALSVPEGENLVLNCSFTDSAIYNLQWFRQDPGKGLTSLLL<br>IQSSQREQTSGRLNASLDKSSGRSTLYIAASQPGDSATYLCAEGNAGGTSYGKLTFGQ<br>GTILTVHPNIQNPDPAVYQLRDSKSSDKSVCLFTDFDSQTNVSQSKDSDVYITDKCVL<br>DMRSMDFKSNSAVAWSNKSDFACANAFNNSIIPEDTFFPSPESSCDVKLVEKSFETDT<br>NLNFQNLSVIGFRILLLKVAGFNLLMTLRLWSS | TCR 18<br>Full sequence<br>Cysteine-<br>modified<br>*Homo sapiens*<br>(aa) |
| 354 | MGIRLLCRVAFCFLAVGLVDVKVTQSSRYLVKRTGEKVFLECVQDMDHENMFWYR<br>QDPGLGLRLIYFSYDVKMKEKGDIPEGYSVSREKKERFSLILESASTNQTSMYLCASSS<br>WGQSTGEQYFGPGTRLTVTEDLKNVFPPEVAVFEPSEAEISHTQKATLVCLATGFYPD<br>HVELSWWVNGKEVHSGVCTDPQPLKEQPALNDSRYCLSSRLRVSATFWQNPRNHFR<br>CQVQFYGLSENDEWTQDRAKPVTQIVSAEAWGRADCGFTSESYQQGVLSATILYEILL<br>GKATLYAVLVSALVLMAMVKRKDSRGGSGATNFSLLKQAGDVEENPGPMSLSSLLK<br>VVTASLWLGPGIAQKITQTQPGMFVQEKEAVTLDCTYDTSDQSYGLFWYKQPSSGEM<br>IFLIYQGSYDEQNATEGRYSLNFQKARKSANLVISASQLGDSAMYFCAMRENTGTASK | TCR 19<br>Full sequence<br>Cysteine-<br>modified<br>*Homo sapiens*<br>(aa) |

| SEQ ID NO. | SEQUENCE | DESCRIPTION |
|---|---|---|
| | LTFGTGTRLQVTLDIQNPDPAVYQLRDSKSSDKSVCLFTDFDSQTNVSQSKDSDVYIT<br>DKCVLDMRSMDFKSNSAVAWSNKSDFACANAFNNSIIPEDTFFPSPESSCDVKLVEKS<br>FETDTNLNFQNLSVIGFRILLLKVAGFNLLMTLRLWSS | |
| 355 | MLLLLLLLGPGSGLGAVVSQHPSRVICKSGTSVKIECRSLDFQATTMFWYRQFPKQSL<br>MLMATSNEGSKATYEQGVEKDKFLINHASLTLSTLTVTSAHPEDSSFYICSASSLARRS<br>YEQYFGPGTRLTVTEDLKNVFPPEVAVFEPSEAEISHTQKATLVCLATGFYPDHVELS<br>WWVNGKEVHSGVCTDPQPLKEQPALNDSRYCLSSRLRVSATFWQNPRNHFRCQVQF<br>YGLSENDEWTQDRAKPVTQIVSAEAWGRADCGFTSESYQQGVLSATILYEILLGKATL<br>YAVLVSALVLMAMVKRKDSRGGSGATNFSLLKQAGDVEENPGPMNMLTASLLRAVI<br>ASICVVSSMAQKVTQAQTEISVVEKEDVTLDCVYETRDTTYYLFWYKQPPSGELVFLI<br>RRNSFDEQNEISGRYSWNFQKSTSSFNFTITASQVVDSAVYFCALWTGANNLFFGTGT<br>RLTVIPYIQNPDPAVYQLRDSKSSDKSVCLFTDFDSQTNVSQSKDSDVYITDKCVLDM<br>RSMDFKSNSAVAWSNKSDFACANAFNNSIIPEDTFFPSPESSCDVKLVEKSFETDTNLN<br>FQNLSVIGFRILLLKVAGFNLLMTLRLWSS | TCR 20<br>Full sequence<br>Cysteine-modified<br>*Homo sapiens*<br>(aa) |
| 356 | MHRPRRPLHPVAPAMSIGLLCCVAFSLLWASPVNAGVTQTPKFQVLKTGQSMTLQCA<br>QDMNHNSMYWYRQDPGMGLRLIYYSASEGTTDKGEVPNGYNVSRLNKREFSLRLES<br>AAPSQTSVYFCASRPWGNQNTEAFFGQGTRLTVVEDLNKVFPPEVAVFEPSEAEISHT<br>QKATLVCLATGFPPDHVELSWWVNGKEVHSGVCTDPQPLKEQPALNDSRYCLSSRLR<br>VSATFWQNPRNHFRCQVQFYGLSENDEWTQDRAKPVTQIVSAEAWGRADCGFTSVS<br>YQQGVLSATILYEILLGKATLYAVLVSALVLMAMVKRKDFGSGATNFSLLKQAGDVE<br>ENPGPMSLSSLLKVVTASLWLGPGIAQKITQTQPGMFVQEKEAVTLDCTYDTSDQSY<br>GLFWYKQPSSGEMIFLIYQGSYDEQNATEGRYSLNFQKARKSANLVISASQLGDSAM<br>YFCAMREGRVTGGGNKLTFGTGTQLKVELNIQNPDDAVYQLRDSKSSDKSVCLFTDF<br>DSQTNVSQSKDSDVYITDKCVLDMRSMDFKSNSAVAWSNKSDFACANAFNNSIIPED<br>TFFPSPESSCDVKLVEKSFETDTNLNFQNLSVIGFRILLLKVAGFNLLMTLRLWSS | TCR 21<br>Full sequence<br>Cysteine-modified<br>*Homo sapiens*<br>(aa) |
| 357 | MGPGLLCWVLLCLLGAGPVDAGVTQSPTHLIKTRGQHVTLRCSPISGHKSVSWYQQV<br>LGQGPQFIFQYYEKEERGRGNFPDRFSARQFPNYSSELNVNALLLGDSALYLCASSRT<br>ENYGYTFGSGTRLTVVEDLNKVFPPEVAVFEPSEAEISHTQKATLVCLATGFFPDHVE<br>LSWWVNGKEVHSGVCTDPQPLKEQPALNDSRYCLSSRLRVSATFWQNPRNHFRCQV<br>QFYGLSENDEWTQDRAKPVTQIVSAEAWGRADCGFTSVSYQQGVLSATILYEILLGK<br>ATLYAVLVSALVLMAMVKRKDFGSGATNFSLLKQAGDVEENPGPMAQELGMQCQA<br>RGILQQMWGVFLLYVSMKMGGTTGQNIDQPTEMTATEGAIVQINCTYQTSGFNGLF<br>WYQQHAGEAPTFLSYNVLDGLEEKGRFSSFLSRSKGYSYLLLKELQMKDSASYLCAV<br>RARMDSNYQLIWGAGTKLIIKPDIQNPDPAVYQLRDSKSSDKSVCLFTDFDSQTNVSQ<br>SKDSDVYITDKCVLDMRSMDFKSNSAVAWSNKSDFACANAFNNSIIPEDTFFPSPESSC<br>DVKLVEKSFETDTNLNFQNLSVIGFRILLLKVAGFNLLMTLRLWSS | TCR 22<br>Full sequence<br>Cysteine-modified<br>*Homo sapiens*<br>(aa) |
| 358 | MGIRLLCRVAFCFLAVGLVDVKVTQSSRYLVKRTGEKVFLECVQDMDHENMFWYR<br>QDPGLGLRLIYFSYDVKMKEKGDIPEGYSVSREKKERFSLILESASTNQTSMYLCASSP<br>WGQSNQPQHFGDGTRLSILEDLNKVFPPEVAVFEPSEAEISHTQKATLVCLATGFFPDH<br>VELSWWVNGKEVHSGVCTDPQPLKEQPALNDSRYCLSSRLRVSATFWQNPRNHFRC<br>QVQFYGLSENDEWTQDRAKPVTQIVSAEAWGRADCGFTSVSYQQGVLSATILYEILL<br>GKATLYAVLVSALVLMAMVKRKDFGSGATNFSLLKQAGDVEENPGPMSLSSLLKVV<br>TASLWLGPGIAQKITQTQPGMFVQEKEAVTLDCTYDTSDQSYGLFWYKQPSSGEMIFL<br>IYQGSYDEQNATEGRYSLNFQKARKSANLVISASQLGDSAMYFCAMSPPGGSARQLT<br>FGSGTQLTVLPDIQNPDPAVYQLRDSKSSDKSVCLFTDFDSQTNVSQSKDSDVYITDK<br>CVLDMRSMDFKSNSAVAWSNKSDFACANAFNNSIIPEDTFFPSPESSCDVKLVEKSFE<br>TDTNLNFQNLSVIGFRILLLKVAGFNLLMTLRLWSS | TCR 23<br>Full sequence<br>Cysteine-modified<br>*Homo sapiens*<br>(aa) |
| 359 | MGIRLLCRVAFCFLAVGLVDVKVTQSSRYLVKRTGEKVFLECVQDMDHENMFWYR<br>QDPGLGLRLIYFSYDVKMKEKGDIPEGYSVSREKKERFSLILESASTNQTSMYLCASSP<br>FGRGSYEQYFGPGTRLTVTEDLKNVFPPEVAVFEPSEAEISHTQKATLVCLATGFYPD<br>HVELSWWVNGKEVHSGVCTDPQPLKEQPALNDSRYCLSSRLRVSATFWQNPRNHFR<br>CQVQFYGLSENDEWTQDRAKPVTQIVSAEAWGRADCGFTSESYQQGVLSATILYEILL<br>GKATLYAVLVSALVLMAMVKRKDSRGGSGATNFSLLKQAGDVEENPGPMSLSSLLK<br>VVTASLWLGPGIAQKITQTQPGMFVQEKEAVTLDCTYDTSDQSYGLFWYKQPSSGEM<br>IFLIYQGSYDEQNATEGRYSLNFQKARKSANLVISASQLGDSAMYFCAMREGRGDSW<br>GKLQFGAGTQVVVTPDIQNPDPAVYQLRDSKSSDKSVCLFTDFDSQTNVSQSKDSDV<br>YITDKCVLDMRSMDFKSNSAVAWSNKSDFACANAFNNSIIPEDTFFPSPESSCDVKLV<br>EKSFETDTNLNFQNLSVIGFRILLLKVAGFNLLMTLRLWSS | TCR 24<br>Full sequence<br>Cysteine-modified<br>*Homo sapiens*<br>(aa) |
| 360 | MGIRLLCRVAFCFLAVGLVDVKVTQSSRYLVKRTGEKVFLECVQDMDHENMFWYR<br>QDPGLGLRLIYFSYDVKMKEKGDIPEGYSVSREKKERFSLILESASTNQTSMYLCASSL<br>WGQSNQPQHFGDGTRLSILEDLNKVFPPEVAVFEPSEAEISHTQKATLVCLATGFFPDH<br>VELSWWVNGKEVHSGVCTDPQPLKEQPALNDSRYCLSSRLRVSATFWQNPRNHFRC<br>QVQFYGLSENDEWTQDRAKPVTQIVSAEAWGRADCGFTSVSYQQGVLSATILYEILL<br>GKATLYAVLVSALVLMAMVKRKDFGSGATNFSLLKQAGDVEENPGPMSLSSLLKVV<br>TASLWLGPGIAQKITQTQPGMFVQEKEAVTLDCTYDTSDQSYGLFWYKQPSSGEMIFL<br>IYQGSYDEQNATEGRYSLNFQKARKSANLVISASQLGDSAMYFCAMREGSLTGGGNK<br>LTFGTGTQLKVELNIQNPDPAVYQLRDSKSSDKSVCLFTDFDSQTNVSQSKDSDVYIT | TCR 25<br>Full sequence<br>Cysteine-modified<br>*Homo sapiens*<br>(aa) |

| SEQ ID NO. | SEQUENCE | DESCRIPTION |
|---|---|---|
| | DKCVLDMRSMDFKSNSAVAWSNKSDFACANAFNNSIIPEDTFFPSPESSCDVKLVEKS<br>FETDTNLNFQNLSVIGFRILLLKVAGFNLLMTLRLWSS | |
| 361 | MSLGLLCCGAFSLLWAGPVNAGVTQTPKFRVLKTGQSMTLLCAQDMNHEYMYWYR<br>QDPGMGLRLIHYSVGEGTTAKGEVPDGYNVSRLKKQNFLLGLESAAPSQTSVYFCAS<br>SYYASGRNYEQYFGPGTRLTVTEDLKNVFPPEVAVFEPSEAEISHTQKATLVCLATGF<br>YPDHVELSWWVNGKEVHSGVCTDPQPLKEQPALNDSRYCLSSRLRVSATFWQNPRN<br>HFRCQVQFYGLSENDEWTQDRAKPVTQIVSAEAWGRADCGFTSESYQQGVLSATILY<br>EILLGKATLYAVLVSALVLMAMVKRKDSRGGSGATNFSLLKQAGDVEENPGPMSLSS<br>LLKVVTASLWLGPGIAQKITQTPQGMFVQEKEAVTLDCTYDTSDQSYGLFWYKQPSS<br>GEMIFLIYQGSYDEQNATEGRYSLNFQKARKSANLVISASQLGDSAMYFCAMRDARN<br>NDMRFGAGTRLTVKPNIQNPDPAVYQLRDSKSSDKSVCLFTDFDSQTNVSQSKDSDV<br>YITDKCVLDMRSMDFKSNSAVAWSNKSDFACANAFNNSIIPEDTFFPSPESSCDVKLV<br>EKSFETDTNLNFQNLSVIGFRILLLKVAGFNLLMTLRLWSS | TCR 26<br>Full sequence<br>Cysteine-<br>modified<br>Homo sapiens<br>(aa) |
| 362 | MHRPRRPLHPVAPAMSIGLLCCVAFSLLWASPVNAGVTQTPKFQVLKTGQSMTLQCA<br>QDMNHNSMYWYRQDPGMGLRLIYYSASEGTTDKGEVPNGYNVSRLNKREFSLRLES<br>AAPSQTSVYFCASSEFGSLNEKLFFGSGTQLSVLEDLNKVFPPEVAVFEPSEAEISHTQK<br>ATLVCLATGFFPDHVELSWWVNGKEVHSGVCTDPQPLKEQPALNDSRYCLSSRLRVS<br>ATFWQNPRNHFRCQVQFYGLSENDEWTQDRAKPVTQIVSAEAWGRADCGFTSVSYQ<br>QGVLSATILYEILLGKATLYAVLVSALVLMAMVKRKDFGSGATNFSLLKQAGDVEEN<br>PGPMKLVTSITVLLSLGIMGDAKTTQPNSMESNEEEPVHLPCNHSTISGTDYIHWYRQL<br>PSQGPEYVIHGLTSNVNNRMASLAIAEDRKSSTLILHRATLRDAAVYYCILRVPPQSGG<br>YQKVTFGTGTKLQVIPNIQNPDPAVYQLRDSKSSDKSVCLFTDFDSQTNVSQSKDSDV<br>YITDKCVLDMRSMDFKSNSAVAWSNKSDFACANAFNNSIIPEDTFFPSPESSCDVKLV<br>EKSFETDTNLNFQNLSVIGFRILLLKVAGFNLLMTLRLWSS | TCR 27<br>Full sequence<br>Cysteine-<br>modified<br>Homo sapiens<br>(aa) |
| 363 | MGIRLLCRVAFCFLAVGLVDVKVTQSSRYLVKRTGEKVFLECVQDMDHENMFWYR<br>QDPGLGLRLIYFSYDVKMKEKGDIPEGYSVSREKKERFSLILESASTNQTSMYLCASSL<br>WGRSSGNTIYFGEGSWLTVVEDLNKVFPPEVAVFEPSEAEISHTQKATLVCLATGFFP<br>DHVELSWWVNGKEVHSGVCTDPQPLKEQPALNDSRYCLSSRLRVSATFWQNPRNHF<br>RCQVQFYGLSENDEWTQDRAKPVTQIVSAEAWGRADCGFTSVSYQQGVLSATILYEI<br>LLGKATLYAVLVSALVLMAMVKRKDFGSGATNFSLLKQAGDVEENPGPMMISLRVL<br>LVILWLQLSWVWSQRKEVEQDPGPFNVPEGATVAFNCTYSNSASQSFFWYRQDCRK<br>EPKLLMSVYSSGNEDGRFTAQLNRASQYISLLIRDSKLSDSATYLCVVRGGGTSYGKL<br>TFGQGTILTVHPNIQNPDPAVYQLRDSKSSDKSVCLFTDFDSQTNVSQSKDSDVYITDK<br>CVLDMRSMDFKSNSAVAWSNKSDFACANAFNNSIIPEDTFFPSPESSCDVKLVEKSFE<br>TDTNLNFQNLSVIGFRILLLKVAGFNLLMTLRLWSS | TCR 28<br>Full sequence<br>Cysteine-<br>modified<br>Homo sapiens<br>(aa) |
| 364 | MSNQVLCCVVLCLLGANTVDGGITQSPKYLFRKEGQNVTLSCEQNLNHDAMYWYR<br>QDPGQGLRLIYYSQIVNDFQKGDIAEGYSVSREKKESFPLTVTSAQKNPTAFYLCASSP<br>WGRATNEQFFGPGTRLTVLEDLKNVFPPEVAVFEPSEAEISHTQKATLVCLATGFYPD<br>HVELSWWVNGKEVHSGVCTDPQPLKEQPALNDSRYCLSSRLRVSATFWQNPRNHFR<br>CQVQFYGLSENDEWTQDRAKPVTQIVSAEAWGRADCGFTSESYQQGVLSATILYEILL<br>GKATLYAVLVSALVLMAMVKRKDSRGGSGATNFSLLKQAGDVEENPGPMSLSSLLK<br>VVTASLWLGPGIAQKITQTPQGMFVQEKEAVTLDCTYDTSDQSYGLFWYKQPSSGEM<br>IFLIYQGSYDEQNATEGRYSLNFQKARKSANLVISASQLGDSAMYFCAMRLNTGTASK<br>LTFGTGTRLQVTLDIQNPDPAVYQLRDSKSSDKSVCLFTDFDSQTNVSQSKDSDVYIT<br>DKCVLDMRSMDFKSNSAVAWSNKSDFACANAFNNSIIPEDTFFPSPESSCDVKLVEKS<br>FETDTNLNFQNLSVIGFRILLLKVAGFNLLMTLRLWSS | TCR 29<br>Full sequence<br>Cysteine-<br>modified<br>Homo sapiens<br>(aa) |
| 365 | MDTWLVCWAIFSLLKAGLTEPEVTQTPSHQVTQMGQEVILRCVPISNHLYFYWYRQI<br>LGQKVEFLVSFYNNEISEKSEIFDDQFSVERPDGSNFTLKIRSTKLEDSAMYFCASSRQP<br>SSGNTIYFGEGSWLTVVEDLNKVFPPEVAVFEPSEAEISHTQKATLVCLATGFFPDHVE<br>LSWWVNGKEVHSGVCTDPQPLKEQPALNDSRYCLSSRLRVSATFWQNPRNHFRCQV<br>QFYGLSENDEWTQDRAKPVTQIVSAEAWGRADCGFTSVSYQQGVLSATILYEILLGK<br>ATLYAVLVSALVLMAMVKRKDFGSGATNFSLLKQAGDVEENPGPMRLVARVTVFLT<br>FGTIIDAKTTOPPSMDCAEGRAANLPCNHSTISGNEYVYWYRQIHSQGPQYIIHGLKNN<br>ETNEMASLIITEDRKSSTLILPHATLRDTAVYYCIVRGTSVLQGNEKLTFGTGTRLTIIP<br>NIQNPDPAVYQLRDSKSSDKSVCLFTDFDSQTNVSQSKDSDVYITDKCVLDMRSMDF<br>KSNSAVAWSNKSDFACANAFNNSIIPEDTFFPSPESSCDVKLVEKSFETDTNLNFQNLS<br>VIGFRILLLKVAGFNLLMTLRLWSS | TCR 30<br>Full sequence<br>Cysteine-<br>modified<br>Homo sapiens<br>(aa) |
| 366 | MGTRLLFWVAFCLLGADHTGAGVSQSPSNKVTEKGKDVELRCDPISGHTALYWRQ<br>SLGQGLEFLIYFQGNSAPDKSGLPSDRFSAERTGGSVSTLTIQRTQQEDSAVYLCASSR<br>FLGSTDTQYFGPGTRLTVLEDLKNVFPPEVAVFEPSEAEISHTQKATLVCLATGFYPDH<br>VELSWWVNGKEVHSGVCTDPQPLKEQPALNDSRYCLSSRLRVSATFWQNPRNHFRC<br>QVQFYGLSENDEWTQDRAKPVTQIVSAEAWGRADCGFTSESYQQGVLSATILYEILL<br>GKATLYAVLVSALVLMAMVKRKDSRGGSGATNFSLLKQAGDVEENPGPMAMLLGA<br>SVLILWLQPDWVNSQQKNDDQQVKQNSPSLSVQEGRISILNCDYTNSMFDYFLWYKK<br>YPAEGPTFLISISSIKDKNEDGRFTVFLNKSAKHLSLHIVPSQPGDSAVYFCAASERGTY | TCR 31<br>Full sequence<br>Cysteine-<br>modified<br>Homo sapiens<br>(aa) |

| SEQ ID NO. | SEQUENCE | DESCRIPTION |
|---|---|---|
| | KYIFGTGTRLKVLANIQNPDPAVYQLRDSKSSDKSVCLFTDFDSQTNVSQSKDSDVYI TDKCVLDMRSMDFKSNSAVAWSNKSDFACANAFNNSIIPEDTFFPSPESSCDVKLVEK SFETDTNLNFQNLSVIGFRILLLKVAGFNLLMTLRLWSS | |
| 367 | MGFRLLCCVAFCLLGAGPVDSGVTQTPKHLITATGQRVTLRCSPRSGDLSVYWYQQS LDQGLQFLIQYYNGEERAKGNILERFSAQQFPDLHSELNLSSLELGDSALYFCASSVGG DHSDEQFFGPGTRLTVLEDLKNVFPPEVAVFEPSEAEISHTQKATLVCLATGFYPDHVE LSWWVNGKEVHSGVCTDPQPLKEQPALNDSRYCLSSRLRVSATFWQNPRNHFRCQV QFYGLSENDEWTQDRAKPVTQIVSAEAWGRADCGFTSESYQQGVLSATILYEILLGK ATLYAVLVSALVLMAMVKRKDSRGGSGATNFSLLKQAGDVEENPGPMVLKFSVSIL WIQLAWVSTQLLEQSPQFLSIQEGENLTVYCNSSSVFSSLQWYRQEPGEGPVLLVTVV TGGEVKKLKRLTFQFGDARKDSSLHITAAQPGDTGLYLCAGGSNYKLTFGKGTLLTV NPNIQNPDPAVYQLRDSKSSDKSVCLFTDFDSQTNVSQSKDSDVYITDKCVLDMRSM DFKSNSAVAWSNKSDFACANAFNNSIIPEDTFFPSPESSCDVKLVEKSFETDTNLNFQN LSVIGFRILLLKVAGFNLLMTLRLWSS | TCR 32 Full sequence Cysteine-modified Homo sapiens (aa) |
| 368 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCASTPRD TYEQYFGPGTRLTVTEDLKNVFPPEVAVFEPSEAEISHTQKATLVCLATGFYPDHVELS WWVNGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRGGSGATNFSLLKQAGDVEENPGPMMKSLRVLLVIL WLQLSWVWSQQKEVEQNSGPLSVPEGAIASLNCTYSDRGSQSFFWYRQYSGKSPELI MFIYSNGDKEDGRFTAQLNKASQYVSLLIRDSQPSDSATYLCAVNAHHTGGFKTIFGA GTRLFVKANIQNPDPAVYQLRDSKSSDKSVCLFTDFDSQTNVSQSKDSDVYITDKCVL DMRSMDFKSNSAVAWSNKSDFACANAFNNSIIPEDTFFPSPESSCDVKLVEKSFETDT NLNFQNLSVIGFRILLLKVAGFNLLMTLRLWSS | TCR 33 Full sequence Cysteine-modified Homo sapiens (aa) |
| 369 | MGPGLLCWALLCLLGAGSVETGVTQSPTHLIKTRGQQVTLRCSSQSGHNTVSWYQQ ALGQGPQFIFQYYREEENGRGNFPPRFSGLQFPNYSSELNVNALELDDSALYCASSSY AGSYEQYFGPGTRLTVTEDLKNVFPPEVAVFEPSEAEISHTQKATLVCLATGFYPDHV | TCR 34 Full sequence |
| 370 | ELSWWVNGKEVHSGVCTDPQPLKEQPALNDSRYCLSSRLRVSATFWQNPRNHFRCQ VQFYGLSENDEWTQDRAKPVTQIVSAEAWGRADCGFTSESYQQGVLSATILYEILLG KATLYAVLVSALVLMAMVKRKDSRGGSGATNFSLLKQAGDVEENPGPMKKLLAMIL WLQLDRLSGELKVEQNPLFLSMQEGKNYTIYCNYSTTSDRLYWYRQDPGKSLESLFV LLSNGAVKQEGRLMASLDTKARLSTLHITAAVHDLSATYFCAVSGTYKYIFGTGTRL KVLANIQNPDPAVYQLRDSKSSDKSVCLFTDFDSQTNVSQSKDSDVYITDKCVLDMR SMDFKSNSAVAWSNKSDFACANAFNNSIIPEDTFFPSPESSCDVKLVEKSFETDTNLNF QNLSVIGFRILLLKVAGFNLLMTLRLWSS MGFRLLCCVAFCLLGAGPVDSGVTQTPKHLITATGQRVTLRCSPRSGDLSVYWYQQS LDQGLQFLIQYYNGEERAKGNILERFSAQQFPDLHSELNLSSLELGDSALYFCASTTSG DSSYNEQFFGPGTRLTVLEDLKNVFPPEVAVFEPSEAEISHTQKATLVCLATGFYPDHV ELSWWVNGKEVHSGVCTDPQPLKEQPALNDSRYCLSSRLRVSATFWQNPRNHFRCQ VQFYGLSENDEWTQDRAKPVTQIVSAEAWGRADCGFTSESYQQGVLSATILYEILLG KATLYAVLVSALVLMAMVKRKDSRGGSGATNFSLLKQAGDVEENPGPMALQSTLGA VWLGLLLNSLWKVAESKDQVFQPSTVASSEGAVVEIFCNHSVSNAYNFFWYLHPGC APRLLVKGSKPSQQGRYNMTYERFSSSLLILQVREADAAVYYCAVAGDYKLSFGAGT TVTVRANIQNPDPAVYQLRDSKSSDKSVCLFTDFDSQTNVSQSKDSDVYITDKCVLD MRSMDFKSNSAVAWSNKSDFACANAFNNSIIPEDTFFPSPESSCDVKLVEKSFETDTNL NFQNLSVIGFRILLLKVAGFNLLMTLRLWSS | Cysteine-modified Homo sapiens (aa) TCR 35 Full sequence Cysteine-modified Homo sapiens (aa) |
| 371 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCAMTGR SNYEQYFGPGTRLTVTEDLKNVFPPEVAVFEPSEAEISHTQKATLVCLATGFYPDHVE LSWWVNGKEVHSGVCTDPQPLKEQPALNDSRYCLSSRLRVSATFWQNPRNHFRCQV QFYGLSENDEWTQDRAKPVTQIVSAEAWGRADCGFTSESYQQGVLSATILYEILLGK ATLYAVLVSALVLMAMVKRKDSRGGSGATNFSLLKQAGDVEENPGPMMISLRVLLV ILWLQLSWVWSQRKEVEQDPGPFNVPEGATVAFNCTYSNSASQSFFWYRQDCRKEPK LLMSVYSSGNEDGRFTAQLNRASQYISLLIRDSKLSDSATYLCVVNRDNYGQNFVFGP GTRLSVLPYIQNPDPAVYQLRDSKSSDKSVCLFTDFDSQTNVSQSKDSDVYITDKCVL DMRSMDFKSNSAVAWSNKSDFACANAFNNSIIPEDTFFPSPESSCDVKLVEKSFETDT NLNFQNLSVIGFRILLLKVAGFNLLMTLRLWSS | TCR 36 Full sequence Cysteine-modified Homo sapiens (aa) |
| 372 | MGTRLLCWVVLGFLGTDHTGAGVSQSPRYKVAKRGQDVALRCDPISGHVSLFWYQQ ALGQGPEFLTYFQNEAQLDKSGLPSDRFFAERPEGSVSTLKIQRTQQEDSAVYLCASSL LLGAYGYTFGSGTRLTVVEDLNKVFPPEVAVFEPSEAEISHTQKATLVCLATGFYPDH VELSWWVNGKEVHSGVCTDPQPLKEQPALNDSRYCLSSRLRVSATFWQNPRNHFRC QVQFYGLSENDEWTQDRAKPVTQIVSAEAWGRADCGFTSVSYQQGVLSATILYEILL GKATLYAVLVSALVLMAMVKRKDFGSGATNFSLLKQAGDVEENPGPMKKLLAMIL WLQLDRLSGELKVEQNPLFLSMQEGKNYTIYCNYSTTSDRLYWYRQDPGKSLESLFV LLSNGAVKQEGRLMASLDTKARLSTLHITAAVHDLSATYFCAGYSGAGSYQLTFGKG TKLSVIPNIQNPDPAVYQLRDSKSSDKSVCLFTDFDSQTNVSQSKDSDVYITDKCVLD | TCR 37 Full sequence Cysteine-modified Homo sapiens (aa) |

| SEQ ID NO. | SEQUENCE | DESCRIPTION |
|---|---|---|
| | MRSMDFKSNSAVAWSNKSDFACANAFNNSIIPEDTFFPSPESSCDVKLVEKSFETDTNL NFQNLSVIGFRILLLKVAGFNLLMTLRLWSS | |
| 373 | MGPGLLCWVLLCLLGAGSVETGVTQSPTHLIKTRGQQVTLRCSSQSGHNTVSWYQQ ALGQGPQFIFQYYREEENGRGNFPPRFSGLQFPNYSSELNVNALELDDSALYLCASSLV AGGETQYFGPGTRLLVLEDLKNVFPPEVAVFEPSEAEISHTQKATLVCLATGFYPDHV ELSWWVNGKEVHSGVCTDPQPLKEQPALNDSRYCLSSRLRVSATFWQNPRNHFRCQ VQFYGLSENDEWTQDRAKPVTQIVSAEAWGRADCGFTSESYQQGVLSATILYEILLG KATLYAVLVSALVLMAMVKRKDSRGGSGATNFSLLKQAGDVEENPGPMVKMPGAR RQSIMKRILGALLGLLSAQVCCVRGIQVEQSPPDLILQEGANSTLRCNFSDSVNNLQWF HQNPWGQLINLFYIPSGTKQNGRLSATTVATERYSLLYISSSQTTDSGVYFCAVGFND MRFGAGTRLTVKPNIQNPDPAVYQLRDSKSSDKSVCLFTDFDSQTNVSQSKDSDVYIT DKCVLDMRSMDFKSNSAVAWSNKSDFACANAFNNSIIPEDTFFPSPESSCDVKLVEKS FETDTNLNFQNLSVIGFRILLLKVAGFNLLMTLRLWSS | TCR 38 Full sequence Cysteine-modified Homo sapiens (aa) |
| 374 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCASTPRD RGKEAFFGQGTRLTVVEDLNKVFPPEVAVFEPSEAEISHTQKATLVCLATGFFPDHVE LSWWVNGKEVHSGVCTDPQPLKEQPALNDSRYCLSSRLRVSATFWQNPRNHFRCQV QFYGLSENDEWTQDRAKPVTQIVSAEAWGRADCGFTSVSYQQGVLSATILYEILLGK ATLYAVLVSALVLMAMVKRKDFGSGATNFSLLKQAGDVEENPGPMQLTWVSGQQL NQSPQSMFIQEGEDVSMNCTSSSIFNTWLWYKQEPGEGPVLLIALYKAGELTSNGRLT AQFGITRKDSFLNISASIPSDVGIYFCAGYSSSNDYKLSFGAGTTVTVRANIQNPDPAVY QLRDSKSSDKSVCLFTDFDSQTNVSQSKDSDVYITDKCVLDMRSMDFKSNSAVAWSN KSDFACANAFNNSIIPEDTFFPSPESSCDVKLVEKSFETDTNLNFQNLSVIGFRILLLKVA GFNLLMTLRLWSS | TCR 39 Full sequence Cysteine-modified Homo sapiens (aa) |
| 375 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCAITARS SYEQYFGPGTRLTVTEDLKNVFPPEVAVFEPSEAEISHTQKATLVCLATGFYPDHVELS WWVNGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRGGSGATNFSLLKQAGDVEENPGPMHTSTFQNRPQLF LLIWKKLVPGNPFRRSWMKEREMLLITSMLVLWMQLSQVNGQQVMQIPQYQHVQE GEDFTTYCNSSTTLSNIQWYKQRPGGHPVFLIQLVKSGEVKKQKRLTFQFGEAKKNSS LHITATQTTDVGTYFCAGRNNFNKFYFGSGTKLNVKPNIQNPDPAVYQLRDSKSSDKS VCLFTDFDSQTNVSQSKDSDVYITDKCVLDMRSMDFKSNSAVAWSNKSDFACANAF NNSIIPEDTFFPSPESSCDVKLVEKSFETDTNLNFQNLSVIGFRILLLKVAGFNLLMTLRL WSS | TCR 40 Full sequence Cysteine-modified Homo sapiens (aa) |
| 376 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCASNPR DRVSYEQYFGPGTRLTVTEDLKNVFPPEVAVFEPSEAEISHTQKATLVCLATGFYPDH VELSWWVNGKEVHSGVCTDPQPLKEQPALNDSRYCLSSRLRVSATFWQNPRNHFRC QVQFYGLSENDEWTQDRAKPVTQIVSAEAWGRADCGFTSESYQQGVLSATILYEILL GKATLYAVLVSALVLMAMVKRKDSRGGSGATNFSLLKQAGDVEENPGPMMISLRVL LVILWLQLSWVVSQRKEVEQDPGPFNVPEGATVAFNCTYSNSASQSFFWYRQDCRK EPKLLMSVYSSGNEDGRFTAQLNRASQYISLLIRDSKLSDSATYLCVVTFALTGGFKTI FGAGTRLFVKANIQNPDPAVYQLRDSKSSDKSVCLFTDFDSQTNVSQSKDSDVYITDK CVLDMRSMDFKSNSAVAWSNKSDFACANAFNNSIIPEDTFFPSPESSCDVKLVEKSFE TDTNLNFQNLSVIGFRILLLKVAGFNLLMTLRLWSS | TCR 41 Full sequence Cysteine-modified Homo sapiens (aa) |
| 377 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCAKTSRS SYEQYFGPGTRLTVTEDLKNVFPPEVAVFEPSEAEISHTQKATLVCLATGFYPDHVELS WWVNGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRGGSGATNFSLLKQAGDVEENPGPMHTSTFQNRPQLF LLIWKKLVPGNPFRRSWMKEREMLLITSMLVLWMQLSQVNGQQVMQIPQYQHVQE GEDFTTYCNSSTTLSNIQWYKQRPGGHPVFLIQLVKSGEVKKQKRLTFQFGEAKKNSS LHITATQTTDVGTYFCAGPDNFNKFYFGSGTKLNVKPNIQNPDPAVYQLRDSKSSDKS VCLFTDFDSQTNVSQSKDSDVYITDKCVLDMRSMDFKSNSAVAWSNKSDFACANAF NNSIIPEDTFFPSPESSCDVKLVEKSFETDTNLNFQNLSVIGFRILLLKVAGFNLLMTLRL WSS | TCR 42 Full sequence Cysteine-modified Homo sapiens (aa) |
| 378 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCASTPRD SYEQYFGPGTRLTVTEDLKNVFPPEVAVFEPSEAEISHTQKATLVCLATGFYPDHVELS WWVNGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRGGSGATNFSLLKQAGDVEENPGPMMKSLRVLLVIL WLQLSWVVSQQKEVEQNSGPLSVPEGAIASLNCTYSDRGSQSFFWYRQYSGKSPELI MFIYSNGDKEDGRFTAQLNKASQYVSLLIRDSQPSDSATYLCAVNVPTSGTYKYIFGT | TCR 43 Full sequence Cysteine-modified Homo sapiens (aa) |

SEQUENCE TABLE

| SEQ ID NO. | SEQUENCE | DESCRIPTION |
|---|---|---|
| | GTRLKVLANIQNPDPAVYQLRDSKSSDKSVCLFTDFDSQTNVSQSKDSDVYITDKCVL<br>DMRSMDFKSNSAVAWSNKSDFACANAFNNSIIPEDTFFPSPESSCDVKLVEKSFETDT<br>NLNFQNLSVIGFRILLLKVAGFNLLMTLRLWSS | |
| 379 | MGFRLLCCVAFCLLGAGPVDSGVTQTPKHLITATGQRVTLRCSPRSGDLSVYWYQQS<br>LDQGLQFLIQYYNGEERAKGNILERFSAQQFPDLHSELNLSSLELGDSALYFCASSGTP<br>DTQYFGPGTRLTVLEDLKNVFPPEVAVFEPSEAEISHTQKATLVCLATGFYPDHVELS<br>WWVNGKEVHSGVCTDPQPLKEQPALNDSRYCLSSRLRVSATFWQNPRNHFRCQVQF<br>YGLSENDEWTQDRAKPVTQIVSAEAWGRADCGFTSESYQQGVLSATILYEILLGKATL<br>YAVLVSALVLMAMVKRKDSRGGSGATNFSLLKQAGDVEENPGPMAQELGMQCQAR<br>GILQQMWGVFLLYVSMKMGGTTGQNIDQPTEMTATEGAIVQINCTYQTSGFNGLFW<br>YQQHAGEAPTFLSYNVLDGLEEKGRFSSFLSRSKGYSYLLLKELQMKDSASYLCAQY<br>SGGYQKVTFGTGTKLQVIPNIQNPDPAVYQLRDSKSSDKSVCLFTDFDSQTNVSQSKD<br>SDVYITDKCVLDMRSMDFKSNSAVAWSNKSDFACANAFNNSIIPEDTFFPSPESSCDV<br>KLVEKSFETDTNLNFQNLSVIGFRILLLKVAGFNLLMTLRLWSS | TCR 44<br>Full sequence<br>Cysteine-<br>modified<br>Homo sapiens<br>(aa) |
| 380 | MGTRLLFWVAFCLLGAYHTGAGVSQSPSNKVTEKGKDVELRCDPISGHTALYWYRQ<br>RLGQGLEFLIYFQGNSAPDKSGLPSDRFSAERTGESVSTLTIQRTQQEDSAVYLCASSL<br>YLGTTGELFFGEGSRLTVLEDLKNVFPPEVAVFEPSEAEISHTQKATLVCLATGFYPDH<br>VELSWWVNGKEVHSGVCTDPQPLKEQPALNDSRYCLSSRLRVSATFWQNPRNHFRC<br>QVQFYGLSENDEWTQDRAKPVTQIVSAEAWGRADCGFTSESYQQGVLSATILYEILL<br>GKATLYAVLVSALVLMAMVKRKDSRGGSGATNFSLLKQAGDVEENPGPMHTSTFQN<br>RPQLFLLIWKKLVPGNPFRRSWMKEREMLLITSMLVLWMQLSQVNGQQVMQIPQY<br>QHVQEGEDFTTYCNSSTTLSNIQWYKQRPGGHPVFLIQLVKSGEVKKQKRLTFQFGEA<br>KKNSSLHITATQTTDVGTYFCAGSSGAGSYQLTFGKGTKLSVIPNIQNPDPAVYQLRD<br>SKSSDKSVCLFTDFDSQTNVSQSKDSDVYITDKCVLDMRSMDFKSNSAVAWSNKSDF<br>ACANAFNNSIIPEDTFFPSPESSCDVKLVEKSFETDTNLNFQNLSVIGFRILLLKVAGFN<br>LLMTLRLWSS | TCR 45<br>Full sequence<br>Cysteine-<br>modified<br>Homo sapiens<br>(aa) |
| 381 | MGTRLLCWAALCLLGADHTGAGVSQTPSNKVTEKGKYVELRCDPISGHTALYWYRQ<br>SLGQGPEFLIYFQGTGAADDSGLPNDRFFAVRPEGSVSTLKIQRTERGDSAVYLCASSL<br>YLGGSETQYFGPGTRLLVLEDLKNVFPPEVAVFEPSEAEISHTQKATLVCLATGFYPD<br>HVELSWWVNGKEVHSGVCTDPQPLKEQPALNDSRYCLSSRLRVSATFWQNPRNHFR<br>CQVQFYGLSENDEWTQDRAKPVTQIVSAEAWGRADCGFTSESYQQGVLSATILYEILL<br>GKATLYAVLVSALVLMAMVKRKDSRGGSGATNFSLLKQAGDVEENPGPMLLLLVPA<br>FQVIFTLGGTRAQSVTQLDSQVPVFEEAPVELRCNYSSSVSVYLFWYVQYPNQGLQLL<br>LKYLSGSTLVKGINGFEAEFNKSQTSFHLRKPSVHISDTAEYFCAVSPSSGTYKYIFGTG<br>TRLKVLANIQNPDPAVYQLRDSKSSDKSVCLFTDFDSQTNVSQSKDSDVYITDKCVLD<br>MRSMDFKSNSAVAWSNKSDFACANAFNNSIIPEDTFFPSPESSCDVKLVEKSFETDTNL<br>NFQNLSVIGFRILLLKVAGFNLLMTLRLWSS | TCR 46<br>Full sequence<br>Cysteine-<br>modified<br>Homo sapiens<br>(aa) |
| 382 | MDTWLVCWAIFSLLKAGLTEPEVTQTPSHQVTQMGQEVILRCVPISNHLYFYWYRQI<br>LGQKVEFLVSFYNNEISEKSEIFDDQFSVERPDGSNFTLKIRSTKLEDSAMYFCAMTGR<br>TTYEQYFGPGTRLTVTEDLKNVFPPEVAVFEPSEAEISHTQKATLVCLATGFYPDHVEL<br>SWWVNGKEVHSGVCTDPQPLKEQPALNDSRYCLSSRLRVSATFWQNPRNHFRCQVQ<br>FYGLSENDEWTQDRAKPVTQIVSAEAWGRADCGFTSESYQQGVLSATILYEILLGKAT<br>LYAVLVSALVLMAMVKRKDSRGGSGATNFSLLKQAGDVEENPGPMMKSLRVLLVIL<br>WLQLSWVWSQQKEVEQNSGPLSVPEGAIASLNCTYSDRGSQSFFWYRQYSGKSPELI<br>MFIYSNGDKEDGRFTAQLNKASQYVSLLIRDSQPSDSATYLCAVNLLSGSARQLTFGS<br>GTQLTVLPDIQNPDPAVYQLRDSKSSDKSVCLFTDFDSQTNVSQSKDSDVYITDKCVL<br>DMRSMDFKSNSAVAWSNKSDFACANAFNNSIIPEDTFFPSPESSCDVKLVEKSFETDT<br>NLNFQNLSVIGFRILLLKVAGFNLLMTLRLWSS | TCR 47<br>Full sequence<br>Cysteine-<br>modified<br>Homo sapiens<br>(aa) |
| 383 | MDTWLVCWAIFSLLKAGLTEPEVTQTPSHQVTQMGQEVILRCVPISNHLYFYWYRQI<br>LGQKVEFLVSFYNNEISEKSEIFDDQFSVERPDGSNFTLKIRSTKLEDSAMYFCASTGR<br>VSYEQYFGPGTRLTVTEDLKNVFPPEVAVFEPSEAEISHTQKATLVCLATGFYPDHVE<br>LSWWVNGKEVHSGVCTDPQPLKEQPALNDSRYCLSSRLRVSATFWQNPRNHFRCVQ<br>QFYGLSENDEWTQDRAKPVTQIVSAEAWGRADCGFTSESYQQGVLSATILYEILLGK<br>ATLYAVLVSALVLMAMVKRKDSRGGSGATNFSLLKQAGDVEENPGPMMKSLRVLL<br>VILWLQLSWVWSQQKEVEQDPGPLSVPEGAIVSLNCTYSNSAFQYFMWYRQYSRKG<br>PELLMYTYSSGNKEDGRFTAQVDKSSKYISLFIRDSQPSDSATYLCAMRIQGAQKLVF<br>GQGTRLTINPNIQNPDPAVYQLRDSKSSDKSVCLFTDFDSQTNVSQSKDSDVYITDKC<br>VLDMRSMDFKSNSAVAWSNKSDFACANAFNNSIIPEDTFFPSPESSCDVKLVEKSFET<br>DTNLNFQNLSVIGFRILLLKVAGFNLLMTLRLWSS | TCR 48<br>Full sequence<br>Cysteine-<br>modified<br>Homo sapiens<br>(aa) |
| 384 | MDTWLVCWAIFSLLKAGLTEPEVTQTPSHQVTQMGQEVILRCVPISNHLYFYWYRQI<br>LGQKVEFLVSFYNNEISEKSEIFDDQFSVERPDGSNFTLKIRSTKLEDSAMYFCASTPRY<br>SYEQYFGPGTRLTVTEDLKNVFPPEVAVFEPSEAEISHTQKATLVCLATGFYPDHVELS<br>WWVNGKEVHSGVCTDPQPLKEQPALNDSRYCLSSRLRVSATFWQNPRNHFRCQVQF<br>YGLSENDEWTQDRAKPVTQIVSAEAWGRADCGFTSESYQQGVLSATILYEILLGKATL<br>YAVLVSALVLMAMVKRKDSRGGSGATNFSLLKQAGDVEENPGPMMKSLRVLLVIL<br>WLQLSWVWSQQKEVEQNSGPLSVPEGAIASLNCTYSDRGSQSFFWYRQYSGKSPELI<br>MFIYSNGDKEDGRFTAQLNKASQYVSLLIRDSQPSDSATYLCAVNIGTSGTYKYIFGT | TCR 49<br>Full sequence<br>Cysteine-<br>modified<br>Homo sapiens<br>(aa) |

US 11,952,408 B2

401 402

-continued

SEQUENCE TABLE

| SEQ ID NO. | SEQUENCE | DESCRIPTION |
|---|---|---|
| | GTRLKVLANIQNPDPAVYQLRDSKSSDKSVCLFTDFDSQTNVSQSKDSDVYITDKCVL DMRSMDFKSNSAVAWSNKSDFACANAFNNSIIPEDTFFPSPESSCDVKLVEKSFETDT NLNFQNLSVIGFRILLLKVAGFNLLMTLRLWSS | |
| 385 | MGFRLLCCVAFCLLGAGPVDSGVTQTPKHLITATGQRVTLRCSPRSGDLSVYWYQQS LDQGLQFLIHYYNGEERAKGNILERFSAQQFPDLHSELNLSSLELGDSALYFCASSATR DAYGYTFGSGTRLTVVEDLNKVFPPEVAVFEPSEAEISHTQKATLVCLATGFFPDHVE LSWWVNGKEVHSGVCTDPQPLKEQPALNDSRYCLSSRLRVSATFWQNPRNHFRCQV QFYGLSENDEWTQDRAKPVTQIVSAEAWGRADCGFTSVSYQQGVLSATILYEILLGK ATLYAVLVSALVLMAMVKRKDFGSGATNFSLLKQAGDVEENPGPMKTFAGFSFLFL WLQLDCMSRGEDVEQSLFLSVREGDSSVINCTYTDSSSTYLYWYKQEPGAGLQLLTYI FSNMDMKQDQRLTVLLNKKDKHLSLRIADTQTGTRLSDSAIYFCAESPPGTYKYIFGTGTRL KVLANIQNPDPAVYQLRDSKSSDKSVCLFTDFDSQTNVSQSKDSDVYITDKCVLDMR SMDFKSNSAVAWSNKSDFACANAFNNSIIPEDTFFPSPESSCDVKLVEKSFETDTNLNF QNLSVIGFRILLLKVAGFNLLMTLRLWSS | TCR 50 Full sequence Cysteine-modified Homo sapiens (aa) |
| 386 | MDTWLVCWAIFSLLKAGLTEPEVTQTPSHQVTQMGQEVILRCVPISNHLYFYWYRQI LGQKVEFLVSFYNNEISEKSEIFDDQFSVERPDGSNFTLKIRSTKLEDSAMYFCAISRV SYEQYFGPGTRLTVTEDLKNVFPPEVAVFEPSEAEISHTQKATLVCLATGFYPDHVELS WWVNGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLGKATL YAVLVSALVLMAMVKRKDSRGGSGATNFSLLKQAGDVEENPGPMMKSLRVLLVIL WLQLSWVWSQQKEVEQNSGPLSVPEGAIASLNCTYSDRGSQSFFWYRQYSGKSPELI MSIYSNGDKEDGRFTAQLNKASQYVSLLIRDSQPSDSATYLCAVNMRGGGSNYKLTF GKGTLLTVNPNIQNPDPAVYQLRDSKSSDKSVCLFTDFDSQTNVSQSKDSDVYITDKC VLDMRSMDFKSNSAVAWSNKSDFACANAFNNSIIPEDTFFPSPESSCDVKLVEKSFET DTNLNFQNLSVIGFRILLLKVAGFNLLMTLRLWSS | TCR 51 Full sequence Cysteine-modified Homo sapiens (aa) |
| 387 | MGFRLLCCVAFCLLGAGPVDSGVTQTPKHLITATGQRVTLRCSPRSGDLSVYWYQQS LDQGLQFLIQYYNGEERAKGNILERFSAQQFPDLHSELNLSSLELGDSALYFCASSVGD LNNEQFFGPGTRLTVLEDLKNVFPPEVAVFEPSEAEISHTQKATLVCLATGFYPDHVEL SWWVNGKEVHSGVCTDPQPLKEQPALNDSRYCLSSRLRVSATFWQNPRNHFRCQVQ FYGLSENDEWTQDRAKPVTQIVSAEAWGRADCGFTSESYQQGVLSATILYEILLGKAT LYAVLVSALVLMAMVKRKDSRGGSGATNFSLLKQAGDVEENPGPMVLKFSVSILWI QLAWVSTQLLEQSPQFLSIQEGENLTVYCNSSSVFSSLQWYREPEGEPVLLVTVVTG GEVKKLKRLTFQFGDARKDSSLHITAAQPGDTGLYLCAGARDYKLSFGAGTTVTVRA NIQNPDPAVYQLRDSKSSDKSVCLFTDFDSQTNVSQSKDSDVYITDKCVLDMRSMDF KSNSAVAWSNKSDFACANAFNNSIIPEDTFFPSPESSCDVKLVEKSFETDTNLNFQNLS VIGFRILLLKVAGFNLLMTLRLWSS | TCR 52 Full sequence Cysteine-modified Homo sapiens (aa) |
| 388 | MGTSLLCWVVLGFLGTDHTGAGVSQSPRYKVTKRGQDVALRCDPISGHVSLYWYRQ ALGQGPEFLTYFNYEAQQDKSGLPNDRFSAERPEGSISTLTIQRTEQRDSAMYRCASSG SGTSGYNEQFFGPGTRLTVLEDLKNVFPPEVAVFEPSEAEISHTQKATLVCLATGFYPD HVELSWWVNGKEVHSGVCTDPQPLKEQPALNDSRYCLSSRLRVSATFWQNPRNHFR CQVQFYGLSENDEWTQDRAKPVTQIVSAEAWGRADCGFTSESYQQGVLSATILYEILL GKATLYAVLVSALVLMAMVKRKDSRGGSGATNFSLLKQAGDVEENPGPMASAPISM LAMLFTLSGLRAQSVAQPEDQVNVAEGNPLTVKCTYSVSGNPYLFWYVQYPNRGLQ FLLKYITGDNLVKGSYGFEAEFNKSQTSFHLKKPSALVSDSALYFCAVRDFGSGTYKY IFGTGTRLKVLANIQNPDPAVYQLRDSKSSDKSVCLFTDFDSQTNVSQSKDSDVYITD KCVLDMRSMDFKSNSAVAWSNKSDFACANAFNNSIIPEDTFFPSPESSCDVKLVEKSF ETDTNLNFQNLSVIGFRILLLKVAGFNLLMTLRLWSS | TCR 53 Full sequence Cysteine-modified Homo sapiens (aa) |
| 389 | TCR 15 - Alpha Native Homo sapiens (nt) | |
| 390 | TCR 15 - Beta Native Homo sapiens (nt) | |
| 391 | TCR 15 Full sequence Native Homo sapiens (aa) | |
| 392 | TCR 16 Full sequence Native Homo sapiens (aa) | |
| 393 | TCR 17 Full sequence Native Homo sapiens (aa) | |
| 394 | TCR 18 Full sequence Native Homo sapiens (aa) | |
| 395 | TCR 19 Full sequence Native Homo sapiens (aa) | |
| 396 | TCR 20 Full sequence Native Homo sapiens (aa) | |
| 397 | TCR 21 Full sequence Native Homo sapiens (aa) | |
| 398 | TCR 22 Full sequence Native Homo sapiens (aa) | |
| 399 | TCR 23 Full sequence Native Homo sapiens (aa) | |

SEQUENCE TABLE

| SEQ ID NO. | SEQUENCE | DESCRIPTION |
|---|---|---|
| 400 | TCR 24 Full sequence Native *Homo sapiens* (aa) | |
| 401 | TCR 25 Full sequence Native *Homo sapiens* (aa) | |
| 402 | TCR 26 Full sequence Native *Homo sapiens* (aa) | |
| 403 | TCR 27 Full sequence Native *Homo sapiens* (aa) | |
| 404 | TCR 28 Full sequence Native *Homo sapiens* (aa) | |
| 405 | TCR 29 Full sequence Native *Homo sapiens* (aa) | |
| 406 | TCR 30 Full sequence Native *Homo sapiens* (aa) | |
| 407 | TCR 31 Full sequence Native *Homo sapiens* (aa) | |
| 408 | TCR 32 Full sequence Native *Homo sapiens* (aa) | |
| 409 | TCR 33 Full sequence Native *Homo sapiens* (aa) | |
| 410 | TCR 34 Full sequence Native *Homo sapiens* (aa) | |
| 411 | TCR 35 Full sequence Native *Homo sapiens* (aa) | |
| 412 | TCR 36 Full sequence Native *Homo sapiens* (aa) | |
| 413 | TCR 37 Full sequence Native *Homo sapiens* (aa) | |
| 414 | TCR 38 Full sequence Native *Homo sapiens* (aa) | |
| 415 | TCR 39 Full sequence Native *Homo sapiens* (aa) | |
| 416 | TCR 40 Full sequence Native *Homo sapiens* (aa) | |
| 417 | TCR 41 Full sequence Native *Homo sapiens* (aa) | |
| 418 | TCR 42 Full sequence Native *Homo sapiens* (aa) | |
| 419 | TCR 43 Full sequence Native *Homo sapiens* (aa) | |
| 420 | TCR 44 Full sequence Native *Homo sapiens* (aa) | |
| 421 | TCR 45 Full sequence Native *Homo sapiens* (aa) | |
| 422 | TCR 46 Full sequence Native *Homo sapiens* (aa) | |
| 423 | TCR 47 Full sequence Native *Homo sapiens* (aa) | |
| 424 | TCR 48 Full sequence Native *Homo sapiens* (aa) | |
| 425 | TCR 49 Full sequence Native *Homo sapiens* (aa) | |
| 426 | TCR 50 Full sequence Native *Homo sapiens* (aa) | |
| 427 | TCR 51 Full sequence Native *Homo sapiens* (aa) | |
| 428 | TCR 52 Full sequence Native *Homo sapiens* (aa) | |
| 429 | TCR 53 Full sequence Native *Homo sapiens* (aa) | |
| 430 | TCR 16 - Alpha Native *Homo sapiens* (nt) | |
| 431 | TCR 16 - Beta Native *Homo sapiens* (nt) | |
| 432 | TCR 15 Codon-optimized/cysteine-modified full sequence *Homo sapiens* (nt) | |
| 433 | TCR 16 Codon-optimized/cysteine-modified full sequence *Homo sapiens* (nt) | |
| 434 | TCR 17 Codon-optimized/cysteine-modified full sequence *Homo sapiens* (nt) | |
| 435 | TCR 18 Codon-optimized/cysteine-modified full sequence *Homo sapiens* (nt) | |

SEQUENCE TABLE

| SEQ ID NO. | SEQUENCE | DESCRIPTION |
|---|---|---|
| 436 | TCR 19 Codon-optimized/cysteine-modified full sequence *Homo sapiens* (nt) | |
| 437 | TCR 20 Codon-optimized/cysteine-modified full sequence *Homo sapiens* (nt) | |
| 438 | TCR 21 Codon-optimized/cysteine-modified full sequence *Homo sapiens* (nt) | |
| 439 | TCR 22 Codon-optimized/cysteine-modified full sequence *Homo sapiens* (nt) | |
| 440 | TCR 23 Codon-optimized/cysteine-modified full sequence *Homo sapiens* (nt) | |
| 441 | TCR 24 Codon-optimized/cysteine-modified full sequence *Homo sapiens* (nt) | |
| 442 | TCR 25 Codon-optimized/cysteine-modified full sequence *Homo sapiens* (nt) | |
| 443 | TCR 26 Codon-optimized/cysteine-modified full sequence *Homo sapiens* (nt) | |
| 444 | TCR 27 Codon-optimized/cysteine-modified full sequence *Homo sapiens* (nt) | |
| 445 | TCR 28 Codon-optimized/cysteine-modified full sequence *Homo sapiens* (nt) | |
| 446 | TCR 29 Codon-optimized/cysteine-modified full sequence *Homo sapiens* (nt) | |
| 447 | TCR 30 Codon-optimized/cysteine-modified full sequence *Homo sapiens* (nt) | |
| 448 | TCR 31 Codon-optimized/cysteine-modified full sequence *Homo sapiens* (nt) | |
| 449 | TCR 32 Codon-optimized/cysteine-modified full sequence *Homo sapiens* (nt) | |
| 450 | TCR 33 Codon-optimized/cysteine-modified full sequence *Homo sapiens* (nt) | |
| 451 | TCR 34 Codon-optimized/cysteine-modified full sequence *Homo sapiens* (nt) | |
| 452 | TCR 35 Codon-optimized/cysteine-modified full sequence *Homo sapiens* (nt) | |
| 453 | TCR 36 Codon-optimized/cysteine-modified full sequence *Homo sapiens* (nt) | |
| 454 | TCR 37 Codon-optimized/cysteine-modified full sequence *Homo sapiens* (nt) | |
| 455 | TCR 38 Codon-optimized/cysteine-modified full sequence *Homo sapiens* (nt) | |
| 456 | TCR 39 Codon-optimized/cysteine-modified full sequence *Homo sapiens* (nt) | |
| 457 | TCR 40 Codon-optimized/cysteine-modified full sequence *Homo sapiens* (nt) | |
| 458 | TCR 41 Codon-optimized/cysteine-modified full sequence *Homo sapiens* (nt) | |
| 459 | TCR 42 Codon-optimized/cysteine-modified full sequence *Homo sapiens* (nt) | |
| 460 | TCR 43 Codon-optimized/cysteine-modified full sequence *Homo sapiens* (nt) | |
| 461 | TCR 44 Codon-optimized/cysteine-modified full sequence *Homo sapiens* (nt) | |
| 462 | TCR 45 Codon-optimized/cysteine-modified full sequence *Homo sapiens* (nt) | |
| 463 | TCR 46 Codon-optimized/cysteine-modified full sequence *Homo sapiens* (nt) | |
| 464 | TCR 47 Codon-optimized/cysteine-modified full sequence *Homo sapiens* (nt) | |
| 465 | TCR 48 Codon-optimized/cysteine-modified full sequence *Homo sapiens* (nt) | |
| 466 | TCR 49 Codon-optimized/cysteine-modified full sequence *Homo sapiens* (nt) | |
| 467 | TCR 50 Codon-optimized/cysteine-modified full sequence *Homo sapiens* (nt) | |
| 468 | TCR 51 Codon-optimized/cysteine-modified full sequence *Homo sapiens* (nt) | |
| 469 | TCR 52 Codon-optimized/cysteine-modified full sequence *Homo sapiens* (nt) | |
| 470 | TCR 53 Codon-optimized/cysteine-modified full sequence *Homo sapiens* (nt) | |
| 471 | TCR 54 Codon-optimized/cysteine-modified full sequence *Homo sapiens* (nt) | |
| 472 | TCR 55 Codon-optimized/cysteine-modified full sequence *Homo sapiens* (nt) | |

-continued

| SEQ ID NO. | SEQUENCE | DESCRIPTION |
|---|---|---|
| 473 | TCR 15 - Alpha Native *Homo sapiens* (aa) | |
| 474 | TCR 15 - Alpha Cysteine-modified *Homo sapiens* (aa) | |
| 475 | TCR 15 - Alpha Native *Homo sapiens* (aa) | |
| 476 | TCR 15 - Alpha Cysteine-modified *Homo sapiens* (aa) | |
| 477 | TCR 15 Alpha variable region *Homo sapiens* (aa) | |
| 478 | TCR 15 alpha CDR3 *Homo sapiens* (aa) | |
| 479 | TCR 15 - Beta Native *Homo sapiens* (aa) | |
| 480 | TCR 15 - Beta Cysteine-modified *Homo sapiens* (aa) | |
| 481 | TCR 15 - Beta Native *Homo sapiens* (aa) | |
| 482 | TCR 15 - Beta Cysteine-modified *Homo sapiens* (aa) | |
| 483 | TCR 15 beta variable region *Homo sapiens* (aa) | |
| 484 | TCR 15 Beta CDR1 *Homo sapiens* (aa) | |
| 485 | TCR 15 Beta CDR2 *Homo sapiens* (aa) | |
| 486 | TCR 15 Beta CDR3 *Homo sapiens* (aa) | |
| 487 | TCR 15 - Beta signal peptide *Homo sapiens* (aa) | |
| 488 | TCR 16 - Alpha Native *Homo sapiens* (aa) | |
| 489 | TCR 16 - Alpha Cysteine-modified *Homo sapiens* (aa) | |
| 490 | TCR 16 - Alpha Native *Homo sapiens* (aa) | |
| 491 | TCR 16 - Alpha Cysteine-modified *Homo sapiens* (aa) | |
| 492 | TCR 16 Alpha variable region *Homo sapiens* (aa) | |
| 493 | TCR 16 alpha CDR3 *Homo sapiens* (aa) | |
| 494 | TCR 16/17 - Beta Native *Homo sapiens* (aa) | |
| 495 | TCR 16/TCR 17 - Beta Cysteine-modified *Homo sapiens* (aa) | |
| 496 | TCR 16/TCR 17 - Beta Native *Homo sapiens* (aa) | |
| 497 | TCR 16/TCR 17 - Beta Cysteine-modified *Homo sapiens* (aa) | |
| 498 | TCR 16/TCR 17- Beta variable region *Homo sapiens* (aa) | |
| 499 | TCR 16/TCR 17 Beta CDR3 *Homo sapiens* (aa) | |
| 500 | TCR 17 - Alpha Native *Homo sapiens* (aa) | |
| 501 | TCR 17 - Alpha Cysteine-modified *Homo sapiens* (aa) | |
| 502 | TCR 17 - Alpha Native *Homo sapiens* (aa) | |
| 503 | TCR 17 - Alpha Cysteine-modified *Homo sapiens* (aa) | |
| 504 | TCR 17 Alpha variable region *Homo sapiens* (aa) | |
| 505 | TCR 17 Alpha CDR3 *Homo sapiens* (aa) | |
| 506 | TCR 18 - Alpha Native *Homo sapiens* (aa) | |
| 507 | TCR 18 - Alpha Cysteine-modified *Homo sapiens* (aa) | |
| 508 | TCR 18 - Alpha Native *Homo sapiens* (aa) | |

| SEQ ID NO. | SEQUENCE | DESCRIPTION |
|---|---|---|
| 509 | TCR 18 - Alpha Cysteine-modified *Homo sapiens* (aa) | |
| 510 | TCR 18 Alpha variable region *Homo sapiens* (aa) | |
| 511 | TCR 18 Alpha CDR3 *Homo sapiens* (aa) | |
| 512 | TCR 18 - Beta Native *Homo sapiens* (aa) | |
| 513 | TCR 18 - Beta Cysteine-modified *Homo sapiens* (aa) | |
| 514 | TCR 18 - Beta Native *Homo sapiens* (aa) | |
| 515 | TCR 18 - Beta Cysteine-modified *Homo sapiens* (aa) | |
| 516 | TCR 18 Beta variable region *Homo sapiens* (aa) | |
| 517 | TCR 18 Beta CDR3 *Homo sapiens* (aa) | |
| 518 | TCR 19 - Alpha Native *Homo sapiens* (aa) | |
| 519 | TCR 19 - Alpha Cysteine-modified *Homo sapiens* (aa) | |
| 520 | TCR 19 - Alpha Native *Homo sapiens* (aa) | |
| 521 | TCR 19 - Alpha Cysteine-modified *Homo sapiens* (aa) | |
| 522 | TCR 19 Alpha variable region *Homo sapiens* (aa) | |
| 523 | TCR 19 Alpha CDR3 *Homo sapiens* (aa) | |
| 524 | TCR 19/TCR 22/TCR 23/TCR 24/TCR 25/TCR 47 Native TCR alpha constant region *Homo sapiens* (aa) | |
| 525 | TCR 19/TCR 22/TCR 23/TCR 24/TCR 25/TCR 29/TCR 47 Alpha constant region *Homo sapiens* (aa) | |
| 526 | TCR 19 - Beta Native *Homo sapiens* (aa) | |
| 527 | TCR 19 - Beta Cysteine-modified *Homo sapiens* (aa) | |
| 528 | TCR 19 - Beta Native *Homo sapiens* (aa) | |
| 529 | TCR 19 - Beta Cysteine-modified *Homo sapiens* (aa) | |
| 530 | TCR 19 Beta variable region *Homo sapiens* (aa) | |
| 531 | TCR 19 Beta CDR3 *Homo sapiens* (aa) | |
| 532 | TCR 20 - Alpha Native *Homo sapiens* (aa) | |
| 533 | TCR 20 - Alpha Cysteine-modified *Homo sapiens* (aa) | |
| 534 | TCR 20 - Alpha Native *Homo sapiens* (aa) | |
| 535 | TCR 20 - Alpha Cysteine-modified *Homo sapiens* (aa) | |
| 536 | TCR 20 Alpha variable region *Homo sapiens* (aa) | |
| 537 | TCR 20 Alpha CDR1 *Homo sapiens* (aa) | |
| 538 | TCR 20 Alpha CDR2 *Homo sapiens* (aa) | |
| 539 | TCR 20 Alpha CDR3 *Homo sapiens* (aa) | |
| 540 | TCR 20 alpha signal peptide *Homo sapiens* (aa) | |
| 541 | TCR 20 - Beta Native *Homo sapiens* (aa) | |
| 542 | TCR 20 - Beta Cysteine-modified *Homo sapiens* (aa) | |
| 543 | TCR 20 - Beta Native *Homo sapiens* (aa) | |
| 544 | TCR 20 - Beta Cysteine-modified *Homo sapiens* (aa) | |
| 545 | TCR 20 Beta variable region *Homo sapiens* (aa) | |

| SEQ ID NO. | SEQUENCE | DESCRIPTION |
|---|---|---|
| 546 | TCR 20 Beta CDR1 *Homo sapiens* (aa) | |
| 547 | TCR 20 Beta CDR2 *Homo sapiens* (aa) | |
| 548 | TCR 20 Beta CDR3 *Homo sapiens* (aa) | |
| 549 | TCR 20 beta signal peptide *Homo sapiens* (aa) | |
| 550 | TCR 21 - Alpha Native *Homo sapiens* (aa) | |
| 551 | TCR 21 - Alpha Cysteine-modified *Homo sapiens* (aa) | |
| 552 | TCR 21 - Alpha Native *Homo sapiens* (aa) | |
| 553 | TCR 21 - Alpha Cysteine-modified *Homo sapiens* (aa) | |
| 554 | TCR 21 Alpha variable region *Homo sapiens* (aa) | |
| 555 | TCR 21 Alpha CDR3 *Homo sapiens* (aa) | |
| 556 | TCR 21 - Beta Native *Homo sapiens* (aa) | |
| 557 | TCR 21 - Beta Cysteine-modified *Homo sapiens* (aa) | |
| 558 | TCR 21 - Beta Native *Homo sapiens* (aa) | |
| 559 | TCR 21 - Beta Cysteine-modified *Homo sapiens* (aa) | |
| 560 | TCR 21 Beta variable region *Homo sapiens* (aa) | |
| 561 | TCR 21/TCR 27 Beta CDR1 *Homo sapiens* (aa) | |
| 562 | TCR 21/TCR 27 Beta CDR2 *Homo sapiens* (aa) | |
| 563 | TCR 21 Beta CDR3 *Homo sapiens* (aa) | |
| 564 | TCR 21/TCR 27 Beta signal peptide *Homo sapiens* (aa) | |
| 565 | TCR 22 - Alpha Native *Homo sapiens* (aa) | |
| 566 | TCR 22 - Alpha Cysteine-modified *Homo sapiens* (aa) | |
| 567 | TCR 22 - Alpha Native *Homo sapiens* (aa) | |
| 568 | TCR 22 - Alpha Cysteine-modified *Homo sapiens* (aa) | |
| 569 | TCR 22 Alpha variable region *Homo sapiens* (aa) | |
| 570 | TCR 22/TCR 44 Alpha CDR1 *Homo sapiens* (aa) | |
| 571 | TCR 22/TCR 44 Alpha CDR2 *Homo sapiens* (aa) | |
| 572 | TCR 22 Alpha CDR3 *Homo sapiens* (aa) | |
| 573 | TCR 22/TCR 44Alpha signal peptide *Homo sapiens* (aa) | |
| 574 | TCR 22 - Beta Native *Homo sapiens* (aa) | |
| 575 | TCR 22 - Beta Cysteine-modified *Homo sapiens* (aa) | |
| 576 | TCR 22 - Beta Native *Homo sapiens* (aa) | |
| 577 | TCR 22 - Beta Cysteine-modified *Homo sapiens* (aa) | |
| 578 | TCR 22 Beta variable region *Homo sapiens* (aa) | |
| 579 | TCR 22 Beta CDR1 *Homo sapiens* (aa) | |
| 580 | TCR 22 Beta CDR2 *Homo sapiens* (aa) | |
| 581 | TCR 22 Beta CDR3 *Homo sapiens* (aa) | |

-continued

| SEQ ID NO. | SEQUENCE | DESCRIPTION |
|---|---|---|
| 582 | TCR 22 Beta signal peptide *Homo sapiens* (aa) | |
| 583 | TCR 23 - Alpha Native *Homo sapiens* (aa) | |
| 584 | TCR 23 - Alpha Cysteine-modified *Homo sapiens* (aa) | |
| 585 | TCR 23 - Alpha Native *Homo sapiens* (aa) | |
| 586 | TCR 23 - Alpha Cysteine-modified *Homo sapiens* (aa) | |
| 587 | TCR 23 Alpha variable region *Homo sapiens* (aa) | |
| 588 | TCR 23 Alpha CDR3 *Homo sapiens* (aa) | |
| 589 | TCR 23 - Beta Native *Homo sapiens* (aa) | |
| 590 | TCR 23 - Beta Cysteine-modified *Homo sapiens* (aa) | |
| 591 | TCR 23 - Beta Native *Homo sapiens* (aa) | |
| 592 | TCR 23 - Beta Cysteine-modified *Homo sapiens* (aa) | |
| 593 | TCR 23 Beta variable region *Homo sapiens* (aa) | |
| 594 | TCR 23 Beta CDR3 *Homo sapiens* (aa) | |
| 595 | TCR 24 - Alpha Native *Homo sapiens* (aa) | |
| 596 | TCR 24 - Alpha Cysteine-modified *Homo sapiens* (aa) | |
| 597 | TCR 24 - Alpha Native *Homo sapiens* (aa) | |
| 598 | TCR 24 - Alpha Cysteine-modified *Homo sapiens* (aa) | |
| 599 | TCR 24 Alpha variable region *Homo sapiens* (aa) | |
| 600 | TCR 24 Alpha CDR3 *Homo sapiens* (aa) | |
| 601 | TCR 24 - Beta Native *Homo sapiens* (aa) | |
| 602 | TCR 24 - Beta Cysteine-modified *Homo sapiens* (aa) | |
| 603 | TCR 24 - Beta Native *Homo sapiens* (aa) | |
| 604 | TCR 24 - Beta Cysteine-modified *Homo sapiens* (aa) | |
| 605 | TCR 24 Beta variable region *Homo sapiens* (aa) | |
| 606 | TCR 24 Beta CDR3 *Homo sapiens* (aa) | |
| 607 | TCR 25 - Alpha Native *Homo sapiens* (aa) | |
| 608 | TCR 25 - Alpha Cysteine-modified *Homo sapiens* (aa) | |
| 609 | TCR 25 - Alpha Native *Homo sapiens* (aa) | |
| 610 | TCR 25 - Alpha Cysteine-modified *Homo sapiens* (aa) | |
| 611 | TCR 25 Alpha variable region *Homo sapiens* (aa) | |
| 612 | TCR 25 Alpha CDR3 *Homo sapiens* (aa) | |
| 613 | TCR 25 - Beta Native *Homo sapiens* (aa) | |
| 614 | TCR 25 - Beta Cysteine-modified *Homo sapiens* (aa) | |
| 615 | TCR 25 - Beta Native *Homo sapiens* (aa) | |
| 616 | TCR 25 - Beta Cysteine-modified *Homo sapiens* (aa) | |
| 617 | TCR 25 Beta variable region *Homo sapiens* (aa) | |
| 618 | TCR 25 Beta CDR3 *Homo sapiens* (aa) | |

-continued

| SEQ ID NO. | SEQUENCE | DESCRIPTION |
|---|---|---|
| 619 | TCR 26 - Alpha Native *Homo sapiens* (aa) | |
| 620 | TCR 26 - Alpha Cysteine-modified *Homo sapiens* (aa) | |
| 621 | TCR 26 - Alpha Native *Homo sapiens* (aa) | |
| 622 | TCR 26 - Alpha Cysteine-modified *Homo sapiens* (aa) | |
| 623 | TCR 26 Alpha variable region *Homo sapiens* (aa) | |
| 624 | TCR 26 Alpha CDR3 *Homo sapiens* (aa) | |
| 625 | TCR 26 - Beta Native *Homo sapiens* (aa) | |
| 626 | TCR 26 - Beta Cysteine-modified *Homo sapiens* (aa) | |
| 627 | TCR 26 - Beta Native *Homo sapiens* (aa) | |
| 628 | TCR 26 - Beta Cysteine-modified *Homo sapiens* (aa) | |
| 629 | TCR 26 Beta variable region *Homo sapiens* (aa) | |
| 630 | TCR 26 Beta CDR3 *Homo sapiens* (aa) | |
| 631 | TCR 26 - Native TCR beta constant region *Homo sapiens* (aa) | |
| 632 | TCR 26 - TCR beta constant region *Homo sapiens* (aa) | |
| 633 | TCR 27 - Alpha Native *Homo sapiens* (aa) | |
| 634 | TCR 27 - Alpha Cysteine-modified *Homo sapiens* (aa) | |
| 635 | TCR 27 - Alpha Native *Homo sapiens* (aa) | |
| 636 | TCR 27 - Alpha Cysteine-modified *Homo sapiens* (aa) | |
| 637 | TCR 27 Alpha variable region *Homo sapiens* (aa) | |
| 638 | TCR 27 Alpha CDR3 *Homo sapiens* (aa) | |
| 639 | TCR 27 - Beta Native *Homo sapiens* (aa) | |
| 640 | TCR 27 - Beta Cysteine-modified *Homo sapiens* (aa) | |
| 641 | TCR 27 - Beta Native *Homo sapiens* (aa) | |
| 642 | TCR 27 - Beta Cysteine-modified *Homo sapiens* (aa) | |
| 643 | TCR 27 Beta variable region *Homo sapiens* (aa) | |
| 644 | TCR 27 Beta CDR3 *Homo sapiens* (aa) | |
| 645 | TCR 28 - Alpha Native *Homo sapiens* (aa) | |
| 646 | TCR 28 - Alpha Cysteine-modified *Homo sapiens* (aa) | |
| 647 | TCR 28 - Alpha Native *Homo sapiens* (aa) | |
| 648 | TCR 28 - Alpha Cysteine-modified *Homo sapiens* (aa) | |
| 649 | TCR 28 Alpha variable region *Homo sapiens* (aa) | |
| 650 | TCR 28 Alpha CDR3 *Homo sapiens* (aa) | |
| 651 | TCR 28 - Beta Native *Homo sapiens* (aa) | |
| 652 | TCR 28 - Beta Cysteine-modified *Homo sapiens* (aa) | |
| 653 | TCR 28 - Beta Native *Homo sapiens* (aa) | |
| 654 | TCR 28 - Beta Cysteine-modified *Homo sapiens* (aa) | |

| SEQ ID NO. | SEQUENCE | DESCRIPTION |
|---|---|---|
| 655 | TCR 28 Beta variable region *Homo sapiens* (aa) | |
| 656 | TCR 28 Beta CDR3 *Homo sapiens* (aa) | |
| 657 | TCR 29 - Alpha Native *Homo sapiens* (aa) | |
| 658 | TCR 29 - Alpha Cysteine-modified *Homo sapiens* (aa) | |
| 659 | TCR 29 - Alpha Native *Homo sapiens* (aa) | |
| 660 | TCR 29 - Alpha Cysteine-modified *Homo sapiens* (aa) | |
| 661 | TCR 29 Alpha variable region *Homo sapiens* (aa) | |
| 662 | TCR 29 Alpha CDR3 *Homo sapiens* (aa) | |
| 663 | TCR 29 - Beta Native *Homo sapiens* (aa) | |
| 664 | TCR 29 - Beta Cysteine-modified *Homo sapiens* (aa) | |
| 665 | TCR 29 - Beta Native *Homo sapiens* (aa) | |
| 666 | TCR 29 - Beta Cysteine-modified *Homo sapiens* (aa) | |
| 667 | TCR 29 Beta variable region *Homo sapiens* (aa) | |
| 668 | TCR 29 Beta CDR1 *Homo sapiens* (aa) | |
| 669 | TCR 29 Beta CDR2 *Homo sapiens* (aa) | |
| 670 | TCR 29 Beta CDR3 *Homo sapiens* (aa) | |
| 671 | TCR 29 Beta signal peptide *Homo sapiens* (aa) | |
| 672 | TCR 30 - Alpha Native *Homo sapiens* (aa) | |
| 673 | TCR 30 - Alpha Cysteine-modified *Homo sapiens* (aa) | |
| 674 | TCR 30 - Alpha Native *Homo sapiens* (aa) | |
| 675 | TCR 30 - Alpha Cysteine-modified *Homo sapiens* (aa) | |
| 676 | TCR 30 Alpha variable region *Homo sapiens* (aa) | |
| 677 | TCR 30 Alpha CDR1 *Homo sapiens* (aa) | |
| 678 | TCR 30 Alpha CDR2 *Homo sapiens* (aa) | |
| 679 | TCR 30 Alpha CDR3 *Homo sapiens* (aa) | |
| 680 | TCR 30 Alpha signal peptide *Homo sapiens* (aa) | |
| 681 | TCR 30 - Beta Native *Homo sapiens* (aa) | |
| 682 | TCR 30 - Beta Cysteine-modified *Homo sapiens* (aa) | |
| 683 | TCR 30 - Beta Native *Homo sapiens* (aa) | |
| 684 | TCR 30 - Beta Cysteine-modified *Homo sapiens* (aa) | |
| 685 | TCR 30 Beta variable region *Homo sapiens* (aa) | |
| 686 | TCR 30 Beta CDR3 *Homo sapiens* (aa) | |
| 687 | TCR 31 - Alpha Native *Homo sapiens* (aa) | |
| 688 | TCR 31 - Alpha Cysteine-modified *Homo sapiens* (aa) | |
| 689 | TCR 31 - Alpha Native *Homo sapiens* (aa) | |
| 690 | TCR 31 - Alpha Cysteine-modified *Homo sapiens* (aa) | |
| 691 | TCR 31 Alpha variable region *Homo sapiens* (aa) | |

| SEQ ID NO. | SEQUENCE | DESCRIPTION |
|---|---|---|
| 692 | TCR 31 Alpha CDR1 *Homo sapiens* (aa) | |
| 693 | TCR 31 Alpha CDR2 *Homo sapiens* (aa) | |
| 694 | TCR 31 Alpha CDR3 *Homo sapiens* (aa) | |
| 695 | TCR 31 Alpha signal peptide *Homo sapiens* (aa) | |
| 696 | TCR 31 - Beta Native *Homo sapiens* (aa) | |
| 697 | TCR 31 - Beta Cysteine-modified *Homo sapiens* (aa) | |
| 698 | TCR 31 - Beta Native *Homo sapiens* (aa) | |
| 699 | TCR 31 - Beta Cysteine-modified *Homo sapiens* (aa) | |
| 700 | TCR 31 Beta variable region *Homo sapiens* (aa) | |
| 701 | TCR 31/TCR 45/TCR 46 Beta CDR1 *Homo sapiens* (aa) | |
| 702 | TCR 31/TCR 45 Beta CDR2 *Homo sapiens* (aa) | |
| 703 | TCR 31 Beta CDR3 *Homo sapiens* (aa) | |
| 704 | TCR 31/TCR 32 Beta signal peptide *Homo sapiens* (aa) | |
| 705 | TCR 32 - Alpha Native *Homo sapiens* (aa) | |
| 706 | TCR 32 - Alpha Cysteine-modified *Homo sapiens* (aa) | |
| 707 | TCR 32 - Alpha Native *Homo sapiens* (aa) | |
| 708 | TCR 32 - Alpha Cysteine-modified *Homo sapiens* (aa) | |
| 709 | TCR 32 Alpha variable region *Homo sapiens* (aa) | |
| 710 | TCR 32/TCR 52 Alpha CDR1 *Homo sapiens* (aa) | |
| 711 | TCR 32/TCR 52 Alpha CDR2 *Homo sapiens* (aa) | |
| 712 | TCR 32 Alpha CDR3 *Homo sapiens* (aa) | |
| 713 | TCR 32/TCR 52 Alpha signal peptide *Homo sapiens* (aa) | |
| 714 | TCR 32 - Beta Native *Homo sapiens* (aa) | |
| 715 | TCR 32 - Beta Cysteine-modified *Homo sapiens* (aa) | |
| 716 | TCR 32 - Beta Native *Homo sapiens* (aa) | |
| 717 | TCR 32 - Beta Cysteine-modified *Homo sapiens* (aa) | |
| 718 | TCR 32 Beta variable region *Homo sapiens* (aa) | |
| 719 | TCR 32/TCR 35/TCR 44/TCR 50/TCR 52 Beta CDR1 *Homo sapiens* (aa) | |
| 720 | TCR 32/TCR 35/TCR 44/TCR 50/TCR 52 Beta CDR2 *Homo sapiens* (aa) | |
| 721 | TCR 32 Beta CDR3 *Homo sapiens* (aa) | |
| 722 | TCR 33 - Alpha Native *Homo sapiens* (aa) | |
| 723 | TCR 33 - Alpha Cysteine-modified *Homo sapiens* (aa) | |
| 724 | TCR 33 - Alpha Native *Homo sapiens* (aa) | |
| 725 | TCR 33 - Alpha Cysteine-modified *Homo sapiens* (aa) | |
| 726 | TCR 33 Alpha variable region *Homo sapiens* (aa) | |
| 727 | TCR 33/TCR 43/TCR 47/TCR 49/TCR 51 Alpha CDR1 *Homo sapiens* (aa) | |

SEQUENCE TABLE

| SEQ ID NO. | SEQUENCE | DESCRIPTION |
|---|---|---|
| 728 | TCR 33/TCR 43/TCR 47/TCR 49/TCR 51 Alpha CDR2 *Homo sapiens* (aa) | |
| 729 | TCR 33 Alpha CDR3 *Homo sapiens* (aa) | |
| 730 | TCR 33/TCR 43/TCR 47/TCR 48/TCR 49/TCR 51 Alpha signal peptide *Homo sapiens* (aa) | |
| 731 | TCR 33 - Beta Native *Homo sapiens* (aa) | |
| 732 | TCR 33 - Beta Cysteine-modified *Homo sapiens* (aa) | |
| 733 | TCR 33 - Beta Native *Homo sapiens* (aa) | |
| 734 | TCR 33 - Beta Cysteine-modified *Homo sapiens* (aa) | |
| 735 | TCR 33 Beta variable region *Homo sapiens* (aa) | |
| 736 | TCR 33 Beta CDR3 *Homo sapiens* (aa) | |
| 737 | TCR 34 - Alpha Native *Homo sapiens* | |
| 738 | TCR 34 - Alpha Cysteine-modified *Homo sapiens* (aa) | |
| 739 | TCR 34 - Alpha Native *Homo sapiens* (aa) | |
| 740 | TCR 34 - Alpha Cysteine-modified *Homo sapiens* (aa) | |
| 741 | TCR 34 Alpha variable region *Homo sapiens* (aa) | |
| 742 | TCR 34/TCR 37 Alpha CDR1 *Homo sapiens* (aa) | |
| 743 | TCR 34/TCR 37 Alpha CDR2 *Homo sapiens* (aa) | |
| 744 | TCR 34 Alpha CDR3 *Homo sapiens* (aa) | |
| 745 | TCR 34/TCR 37 Alpha signal peptide *Homo sapiens* (aa) | |
| 746 | TCR 34 - Beta Native *Homo sapiens* (aa) | |
| 747 | TCR 34 - Beta Cysteine-modified *Homo sapiens* (aa) | |
| 748 | TCR 34 - Beta Native *Homo sapiens* (aa) | |
| 749 | TCR 34 - Beta Cysteine-modified *Homo sapiens* (aa) | |
| 750 | TCR 34 Beta variable region *Homo sapiens* (aa) | |
| 751 | TCR 34/TCR 38 Beta CDR1 *Homo sapiens* (aa) | |
| 752 | TCR 34/TCR 38 Beta CDR2 *Homo sapiens* (aa) | |
| 753 | TCR 34 Beta CDR3 *Homo sapiens* (aa) | |
| 754 | TCR 34 Beta signal peptide *Homo sapiens* (aa) | |
| 755 | TCR 35 - Alpha Native *Homo sapiens* (aa) | |
| 756 | TCR 35 - Alpha Cysteine-modified *Homo sapiens* (aa) | |
| 757 | TCR 35 - Alpha Native *Homo sapiens* (aa) | |
| 758 | TCR 35 - Alpha Cysteine-modified *Homo sapiens* (aa) | |
| 759 | TCR 35 Alpha variable region *Homo sapiens* (aa) | |
| 760 | TCR 35 Alpha CDR1 *Homo sapiens* (aa) | |
| 761 | TCR 35 Alpha CDR2 *Homo sapiens* (aa) | |
| 762 | TCR 35 Alpha CDR3 *Homo sapiens* (aa) | |
| 763 | TCR 35 Alpha signal peptide *Homo sapiens* (aa) | |
| 764 | TCR 35 - Beta Native *Homo sapiens* (aa) | |

SEQUENCE TABLE

| SEQ ID NO. | SEQUENCE | DESCRIPTION |
|---|---|---|
| 765 | TCR 35 - Beta Cysteine-modified *Homo sapiens* (aa) | |
| 766 | TCR 35 - Beta Native *Homo sapiens* (aa) | |
| 767 | TCR 35 - Beta Cysteine-modified *Homo sapiens* (aa) | |
| 768 | TCR 35 Beta variable region *Homo sapiens* (aa) | |
| 769 | TCR 35 Beta CDR3 *Homo sapiens* (aa) | |
| 770 | TCR 35/TCR 44/TCR 50/TCR 52Beta signal peptide *Homo sapiens* (aa) | |
| 771 | TCR 36 - Alpha Native *Homo sapiens* (aa) | |
| 772 | TCR 36 - Alpha Cysteine-modified *Homo sapiens* (aa) | |
| 773 | TCR 36 - Alpha Native *Homo sapiens* (aa) | |
| 774 | TCR 36 - Alpha Cysteine-modified *Homo sapiens* (aa) | |
| 775 | TCR 36 Alpha variable region *Homo sapiens* (aa) | |
| 776 | TCR 36 Alpha CDR3 *Homo sapiens* (aa) | |
| 777 | TCR 36 - Beta Native *Homo sapiens* (aa) | |
| 778 | TCR 36 - Beta Cysteine-modified *Homo sapiens* (aa) | |
| 779 | TCR 36 - Beta Native *Homo sapiens* (aa) | |
| 780 | TCR 36 - Beta Cysteine-modified *Homo sapiens* (aa) | |
| 781 | TCR 36 Beta variable region *Homo sapiens* (aa) | |
| 782 | TCR 36 Beta CDR3 *Homo sapiens* (aa) | |
| 783 | TCR 37 - Alpha Native *Homo sapiens* (aa) | |
| 784 | TCR 37 - Alpha Cysteine-modified *Homo sapiens* (aa) | |
| 785 | TCR 37 - Alpha Native *Homo sapiens* (aa) | |
| 786 | TCR 37 - Alpha Cysteine-modified *Homo sapiens* (aa) | |
| 787 | TCR 37 Alpha variable region *Homo sapiens* (aa) | |
| 788 | TCR 37 Alpha CDR3 *Homo sapiens* (aa) | |
| 789 | TCR 37 - Beta Native *Homo sapiens* (aa) | |
| 790 | TCR 37 - Beta Cysteine-modified *Homo sapiens* (aa) | |
| 791 | TCR 37 - Beta Native *Homo sapiens* (aa) | |
| 792 | TCR 37 - Beta Cysteine-modified *Homo sapiens* (aa) | |
| 793 | TCR 37 Beta variable region *Homo sapiens* (aa) | |
| 794 | TCR 37 Beta CDR3 *Homo sapiens* (aa) | |
| 795 | TCR 38 - Alpha Native *Homo sapiens* (aa) | |
| 796 | TCR 38 - Alpha Cysteine-modified *Homo sapiens* (aa) | |
| 797 | TCR 38 - Alpha Native *Homo sapiens* (aa) | |
| 798 | TCR 38 - Alpha Cysteine-modified *Homo sapiens* (aa) | |
| 799 | TCR 38 Alpha variable region *Homo sapiens* (aa) | |
| 800 | TCR 38 Alpha CDR1 *Homo sapiens* (aa) | |

-continued

| SEQ ID NO. | SEQUENCE | DESCRIPTION |
|---|---|---|
| 801 | TCR 38 Alpha CDR2 *Homo sapiens* (aa) | |
| 802 | TCR 38 Alpha CDR3 *Homo sapiens* (aa) | |
| 803 | TCR 38 Alpha signal peptide *Homo sapiens* (aa) | |
| 804 | TCR 38 - Beta Native *Homo sapiens* (aa) | |
| 805 | TCR 38 - Beta Cysteine-modified *Homo sapiens* (aa) | |
| 806 | TCR 38 - Beta Native *Homo sapiens* (aa) | |
| 807 | TCR 38 - Beta Cysteine-modified *Homo sapiens* (aa) | |
| 808 | TCR 38 Beta variable region *Homo sapiens* (aa) | |
| 809 | TCR 38 Beta CDR3 *Homo sapiens* (aa) | |
| 810 | TCR 38 Beta signal peptide *Homo sapiens* (aa) | |
| 811 | TCR 39 - Alpha Native *Homo sapiens* (aa) | |
| 812 | TCR 39 - Alpha Cysteine-modified *Homo sapiens* (aa) | |
| 813 | TCR 39 - Alpha Native *Homo sapiens* (aa) | |
| 814 | TCR 39 - Alpha Cysteine-modified *Homo sapiens* (aa) | |
| 815 | TCR 39 Alpha variable region *Homo sapiens* (aa) | |
| 816 | TCR 39/TCR 40/TCR 42/TCR 45 Alpha CDR1 *Homo sapiens* (aa) | |
| 817 | TCR 39/TCR 45 Alpha CDR2 *Homo sapiens* (aa) | |
| 818 | TCR 39 Alpha CDR3 *Homo sapiens* (aa) | |
| 819 | TCR 39 Alpha signal peptide *Homo sapiens* (aa) | |
| 820 | TCR 39 - Beta Native *Homo sapiens* (aa) | |
| 821 | TCR 39 - Beta Cysteine-modified *Homo sapiens* (aa) | |
| 822 | TCR 39 - Beta Native *Homo sapiens* (aa) | |
| 823 | TCR 39 - Beta Cysteine-modified *Homo sapiens* (aa) | |
| 824 | TCR 39 Beta variable region *Homo sapiens* (aa) | |
| 825 | TCR 39 Beta CDR3 *Homo sapiens* (aa) | |
| 826 | TCR 40 - Alpha Native *Homo sapiens* (aa) | |
| 827 | TCR 40 - Alpha Cysteine-modified *Homo sapiens* (aa) | |
| 828 | TCR 40 - Alpha Native *Homo sapiens* (aa) | |
| 829 | TCR 40 - Alpha Cysteine-modified *Homo sapiens* (aa) | |
| 830 | TCR 40 Alpha variable region *Homo sapiens* (aa) | |
| 831 | TCR 40/TCR 42 Alpha CDR2 *Homo sapiens* (aa) | |
| 832 | TCR 40/Alpha CDR3 *Homo sapiens* (aa) | |
| 833 | Transmembrane-modified/cysteine modified mouse constant alpha *Mus musculus* (aa) | |
| 834 | TCR 40/TCR 42/TCR 45 Alpha signal peptide *Homo sapiens* (aa) | |
| 835 | TCR 40 - Beta Native *Homo sapiens* (aa) | |
| 836 | TCR 40 - Beta Cysteine-modified *Homo sapiens* (aa) | |
| 837 | TCR 40 - Beta Native *Homo sapiens* (aa) | |

-continued

| SEQ ID NO. | SEQUENCE | DESCRIPTION |
|---|---|---|
| 838 | TCR 40 - Beta Cysteine-modified *Homo sapiens* (aa) | |
| 839 | TCR 40 Beta variable region *Homo sapiens* (aa) | |
| 840 | TCR 40 Beta CDR3 *Homo sapiens* (aa) | |
| 841 | TCR 41 - Alpha Native *Homo sapiens* (aa) | |
| 842 | TCR 41 - Alpha Cysteine-modified *Homo sapiens* (aa) | |
| 843 | TCR 41 - Alpha Native *Homo sapiens* (aa) | |
| 844 | TCR 41 - Alpha Cysteine-modified *Homo sapiens* (aa) | |
| 845 | TCR 41 Alpha variable region *Homo sapiens* (aa) | |
| 846 | TCR 41 Alpha CDR3 *Homo sapiens* (aa) | |
| 847 | TCR 41 - Beta Native *Homo sapiens* (aa) | |
| 848 | TCR 41 - Beta Cysteine-modified *Homo sapiens* (aa) | |
| 849 | TCR 41 - Beta Native *Homo sapiens* (aa) | |
| 850 | TCR 41 - Beta Cysteine-modified *Homo sapiens* (aa) | |
| 851 | TCR 41 Beta variable region *Homo sapiens* (aa) | |
| 852 | TCR 41 Beta CDR3 *Homo sapiens* (aa) | |
| 853 | TCR 42 - Alpha Native *Homo sapiens* (aa) | |
| 854 | TCR 42 - Alpha Cysteine-modified *Homo sapiens* (aa) | |
| 855 | TCR 42 - Alpha Native *Homo sapiens* (aa) | |
| 856 | TCR 42 - Alpha Cysteine-modified *Homo sapiens* (aa) | |
| 857 | TCR 42 Alpha variable region *Homo sapiens* (aa) | |
| 858 | TCR 42 Alpha CDR3 *Homo sapiens* (aa) | |
| 859 | TCR 42 - Beta Native *Homo sapiens* (aa) | |
| 860 | TCR 42 - Beta Cysteine-modified *Homo sapiens* (aa) | |
| 861 | TCR 42 - Beta Native *Homo sapiens* (aa) | |
| 862 | TCR 42 - Beta Cysteine-modified *Homo sapiens* (aa) | |
| 863 | TCR 42 Beta variable region *Homo sapiens* (aa) | |
| 864 | TCR 42 Beta CDR3 *Homo sapiens* (aa) | |
| 865 | TCR 43 - Alpha Native *Homo sapiens* (aa) | |
| 866 | TCR 43 - Alpha Cysteine-modified *Homo sapiens* (aa) | |
| 867 | TCR 43 - Alpha Native *Homo sapiens* (aa) | |
| 868 | TCR 43 - Alpha Cysteine-modified *Homo sapiens* (aa) | |
| 869 | TCR 43 Alpha variable region *Homo sapiens* (aa) | |
| 870 | TCR 43 Alpha CDR3 *Homo sapiens* (aa) | |
| 871 | TCR 43 - Beta Native *Homo sapiens* (aa) | |
| 872 | TCR 43 - Beta Cysteine-modified *Homo sapiens* (aa) | |
| 873 | TCR 43 - Beta Native *Homo sapiens* (aa) | |

SEQUENCE TABLE

| SEQ ID NO. | SEQUENCE | DESCRIPTION |
|---|---|---|
| 874 | TCR 43 - Beta Cysteine-modified *Homo sapiens* (aa) | |
| 875 | TCR 43 Beta variable region *Homo sapiens* (aa) | |
| 876 | TCR 43 Beta CDR3 *Homo sapiens* (aa) | |
| 877 | TCR 44 - Alpha Native *Homo sapiens* (aa) | |
| 878 | TCR 44 - Alpha Cysteine-modified *Homo sapiens* (aa) | |
| 879 | TCR 44 - Alpha Native *Homo sapiens* (aa) | |
| 880 | TCR 44 - Alpha Cysteine-modified *Homo sapiens* (aa) | |
| 881 | TCR 44 Alpha variable region *Homo sapiens* (aa) | |
| 882 | TCR 44 Alpha CDR3 *Homo sapiens* (aa) | |
| 883 | TCR 44 - Beta Native *Homo sapiens* (aa) | |
| 884 | TCR 44 - Beta Cysteine-modified *Homo sapiens* (aa) | |
| 885 | TCR 44 - Beta Native *Homo sapiens* (aa) | |
| 886 | TCR 44 - Beta Cysteine-modified *Homo sapiens* (aa) | |
| 887 | TCR 44 Beta variable region *Homo sapiens* (aa) | |
| 888 | TCR 44 Beta CDR3 *Homo sapiens* (aa) | |
| 889 | TCR 44 Native TCR beta constant region *Homo sapiens* (aa) | |
| 890 | TCR 44 TCR beta constant region *Homo sapiens* (aa) | |
| 891 | TCR 45 - Alpha Native *Homo sapiens* (aa) | |
| 892 | TCR 45 - Alpha Cysteine-modified *Homo sapiens* (aa) | |
| 893 | TCR 45 - Alpha Native *Homo sapiens* (aa) | |
| 894 | TCR 45 - Alpha Cysteine-modified *Homo sapiens* (aa) | |
| 895 | TCR 45 Alpha variable region *Homo sapiens* (aa) | |
| 896 | TCR 45 Alpha CDR3 *Homo sapiens* (aa) | |
| 897 | TCR 45 - Beta Native *Homo sapiens* (aa) | |
| 898 | TCR 45 - Beta Cysteine-modified *Homo sapiens* (aa) | |
| 899 | TCR 45 - Beta Native *Homo sapiens* (aa) | |
| 900 | TCR 45 - Beta Cysteine-modified *Homo sapiens* (aa) | |
| 901 | TCR 45 Beta variable region *Homo sapiens* (aa) | |
| 902 | TCR 45 Beta CDR3 *Homo sapiens* (aa) | |
| 903 | TCR 45 Beta signal peptide *Homo sapiens* (aa) | |
| 904 | TCR 46 - Alpha Native *Homo sapiens* (aa) | |
| 905 | TCR 46 - Alpha Cysteine-modified *Homo sapiens* (aa) | |
| 906 | TCR 46 - Alpha Native *Homo sapiens* (aa) | |
| 907 | TCR 46 - Alpha Cysteine-modified *Homo sapiens* (aa) | |
| 908 | TCR 46 Alpha variable region *Homo sapiens* (aa) | |
| 909 | TCR 46 Alpha CDR1 *Homo sapiens* (aa) | |
| 910 | TCR 46 Alpha CDR2 *Homo sapiens* (aa) | |

| SEQ ID NO. | SEQUENCE | DESCRIPTION |
|---|---|---|
| 911 | TCR 46 Alpha CDR3 *Homo sapiens* (aa) | |
| 912 | TCR 46 Alpha signal peptide *Homo sapiens* (aa) | |
| 913 | TCR 46 - Beta Native *Homo sapiens* (aa) | |
| 914 | TCR 46 - Beta Cysteine-modified *Homo sapiens* (aa) | |
| 915 | TCR 46 - Beta Native *Homo sapiens* (aa) | |
| 916 | TCR 46 - Beta Cysteine-modified *Homo sapiens* (aa) | |
| 917 | TCR 46 Beta variable region *Homo sapiens* (aa) | |
| 918 | TCR 46 Beta CDR2 *Homo sapiens* (aa) | |
| 919 | TCR 46 Beta CDR3 *Homo sapiens* (aa) | |
| 920 | TCR 46 Beta signal peptide *Homo sapiens* (aa) | |
| 921 | TCR 47 - Alpha Native *Homo sapiens* (aa) | |
| 922 | TCR 47 - Alpha Cysteine-modified *Homo sapiens* (aa) | |
| 923 | TCR 47 - Alpha Native *Homo sapiens* (aa) | |
| 924 | TCR 47 - Alpha Cysteine-modified *Homo sapiens* (aa) | |
| 925 | TCR 47 Alpha variable region *Homo sapiens* (aa) | |
| 926 | TCR 47 Alpha CDR3 *Homo sapiens* (aa) | |
| 927 | TCR 47 - Beta Native *Homo sapiens* (aa) | |
| 928 | TCR 47 - Beta Cysteine-modified *Homo sapiens* (aa) | |
| 929 | TCR 47- Beta Native *Homo sapiens* (aa) | |
| 930 | TCR 47 - Beta Cysteine-modified *Homo sapiens* (aa) | |
| 931 | TCR 47 Beta variable region *Homo sapiens* (aa) | |
| 932 | TCR 47 Beta CDR3 *Homo sapiens* (aa) | |
| 933 | TCR 48 - Alpha Native *Homo sapiens* (aa) | |
| 934 | TCR 48 - Alpha Cysteine-modified *Homo sapiens* (aa) | |
| 935 | TCR 48 - Alpha Native *Homo sapiens* (aa) | |
| 936 | TCR 48 - Alpha Cysteine-modified *Homo sapiens* (aa) | |
| 937 | TCR 48 Alpha variable region *Homo sapiens* (aa) | |
| 938 | TCR 48 Alpha CDR1 *Homo sapiens* (aa) | |
| 939 | TCR 48 Alpha CDR2 *Homo sapiens* (aa) | |
| 940 | TCR 48 Alpha CDR3 *Homo sapiens* (aa) | |
| 941 | TCR 48 - Beta Native *Homo sapiens* (aa) | |
| 942 | TCR 48 - Beta Cysteine-modified *Homo sapiens* (aa) | |
| 943 | TCR 48- Beta Native *Homo sapiens* (aa) | |
| 944 | TCR 48 - Beta Cysteine-modified *Homo sapiens* (aa) | |
| 945 | TCR 48 Beta variable region *Homo sapiens* (aa) | |
| 946 | TCR 48 Beta CDR3 *Homo sapiens* (aa) | |

SEQUENCE TABLE

| SEQ ID NO. | SEQUENCE | DESCRIPTION |
|---|---|---|
| 947 | TCR 49 - Alpha Native *Homo sapiens* (aa) | |
| 948 | TCR 49 - Alpha Cysteine-modified *Homo sapiens* (aa) | |
| 949 | TCR 49 - Alpha Native *Homo sapiens* (aa) | |
| 950 | TCR 49 - Alpha Cysteine-modified *Homo sapiens* (aa) | |
| 951 | TCR 49 Alpha variable region *Homo sapiens* (aa) | |
| 952 | TCR 49 Alpha CDR3 *Homo sapiens* (aa) | |
| 953 | TCR 49 - Beta Native *Homo sapiens* (aa) | |
| 954 | TCR 49 - Beta Cysteine-modified *Homo sapiens* (aa) | |
| 955 | TCR 49- Beta Native *Homo sapiens* (aa) | |
| 956 | TCR 49 - Beta Cysteine-modified *Homo sapiens* (aa) | |
| 957 | TCR 49 Beta variable region *Homo sapiens* (aa) | |
| 958 | TCR 49 Beta CDR3 *Homo sapiens* (aa) | |
| 959 | TCR 50 - Alpha Native *Homo sapiens* (aa) | |
| 960 | TCR 50 - Alpha Cysteine-modified *Homo sapiens* (aa) | |
| 961 | TCR 50 - Alpha Native *Homo sapiens* (aa) | |
| 962 | TCR 50 - Alpha Cysteine-modified *Homo sapiens* (aa) | |
| 963 | TCR 50 Alpha variable region *Homo sapiens* (aa) | |
| 964 | TCR 50 Alpha CDR3 *Homo sapiens* (aa) | |
| 965 | TCR 50 - Beta Native *Homo sapiens* (aa) | |
| 966 | TCR 50 - Beta Cysteine-modified *Homo sapiens* (aa) | |
| 967 | TCR 50- Beta Native *Homo sapiens* (aa) | |
| 968 | TCR 50 - Beta Cysteine-modified *Homo sapiens* (aa) | |
| 969 | TCR 50 Beta variable region *Homo sapiens* (aa) | |
| 970 | TCR 50 Beta CDR3 *Homo sapiens* (aa) | |
| 971 | TCR 51 - Alpha Native *Homo sapiens* (aa) | |
| 972 | TCR 51 - Alpha Cysteine-modified *Homo sapiens* (aa) | |
| 973 | TCR 51 - Alpha Native *Homo sapiens* (aa) | |
| 974 | TCR 51 - Alpha Cysteine-modified *Homo sapiens* (aa) | |
| 975 | TCR 51 Alpha variable region *Homo sapiens* (aa) | |
| 976 | TCR 51 Alpha CDR3 *Homo sapiens* (aa) | |
| 977 | TCR 51 - Beta Native *Homo sapiens* (aa) | |
| 978 | TCR 51 - Beta Cysteine-modified *Homo sapiens* (aa) | |
| 979 | TCR 51- Beta Native *Homo sapiens* (aa) | |
| 980 | TCR 51 - Beta Cysteine-modified *Homo sapiens* (aa) | |
| 981 | TCR 51 Beta variable region *Homo sapiens* (aa) | |
| 982 | TCR 51 Beta CDR3 *Homo sapiens* (aa) | |
| 983 | TCR 52 - Alpha Native *Homo sapiens* (aa) | |

SEQUENCE TABLE

| SEQ ID NO. | SEQUENCE | DESCRIPTION |
|---|---|---|
| 984 | TCR 52 - Alpha Cysteine-modified *Homo sapiens* (aa) | |
| 985 | TCR 52 - Alpha Native *Homo sapiens* (aa) | |
| 986 | TCR 52 - Alpha Cysteine-modified *Homo sapiens* (aa) | |
| 987 | TCR 52 Alpha variable region *Homo sapiens* (aa) | |
| 988 | TCR 52 Alpha CDR3 *Homo sapiens* (aa) | |
| 989 | TCR 52 - Beta Native *Homo sapiens* (aa) | |
| 990 | TCR 52 - Beta Cysteine-modified *Homo sapiens* (aa) | |
| 991 | TCR 52- Beta Native *Homo sapiens* (aa) | |
| 992 | TCR 52 - Beta Cysteine-modified *Homo sapiens* (aa) | |
| 993 | TCR 52 Beta variable region *Homo sapiens* (aa) | |
| 994 | TCR 52 Beta CDR3 *Homo sapiens* (aa) | |
| 995 | TCR 53 - Alpha Native *Homo sapiens* (aa) | |
| 996 | TCR 53 - Alpha Cysteine-modified *Homo sapiens* (aa) | |
| 997 | TCR 53 - Alpha Native *Homo sapiens* (aa) | |
| 998 | TCR 53 - Alpha Cysteine-modified *Homo sapiens* (aa) | |
| 999 | TCR 53 Alpha variable region *Homo sapiens* (aa) | |
| 1000 | TCR 53 Alpha CDR1 *Homo sapiens* (aa) | |
| 1001 | TCR 53 Alpha CDR2 *Homo sapiens* (aa) | |
| 1002 | TCR 53 Alpha CDR3 *Homo sapiens* (aa) | |
| 1003 | TCR 53 Alpha signal peptide *Homo sapiens* (aa) | |
| 1004 | TCR 53 - Beta Native *Homo sapiens* (aa) | |
| 1005 | TCR 53 - Beta Cysteine-modified *Homo sapiens* (aa) | |
| 1006 | TCR 53- Beta Native *Homo sapiens* (aa) | |
| 1007 | TCR 53 - Beta Cysteine-modified *Homo sapiens* (aa) | |
| 1008 | TCR 53 Beta variable region *Homo sapiens* (aa) | |
| 1009 | TCR 53 Beta CDR2 *Homo sapiens* (aa) | |
| 1010 | TCR 53 Beta CDR3 *Homo sapiens* (aa) | |
| 1011 | TCR 53 Beta signal peptide *Homo sapiens* (aa) | |
| 1012 | Mouse alpha constant *Mus musculus* (aa) | |
| 1013 | Mouse beta constant *Mus musculus* (aa) | |
| 1014 | Mouse alpha constant *Mus musculus* (aa) | |
| 1015 | Mouse alpha constant *Mus musculus* (aa) | |
| 1016 | Mouse beta constant *Mus musculus* (aa) | |
| 1017 | Mouse alphaconstant Cysteine-substituted *Mus musculus* (aa) | |
| 1018 | Mouse alpha constant Transmembrane modified *Mus musculus* (aa) | |
| 1019 | TCR 17 - Alpha Native *Homo sapiens* (nt) | |

SEQUENCE TABLE

| SEQ ID NO. | SEQUENCE | DESCRIPTION |
|---|---|---|
| 1020 | TCR 17 - Beta Native *Homo sapiens* (nt) | |
| 1021 | TCR 18 - Alpha Native *Homo sapiens* (nt) | |
| 1022 | TCR 18 - Beta Native *Homo sapiens* (nt) | |
| 1023 | TCR 19 - Alpha Native *Homo sapiens* (nt) | |
| 1024 | TCR 19 - Beta Native *Homo sapiens* (nt) | |
| 1025 | TCR 20 - Alpha Native *Homo sapiens* (nt) | |
| 1026 | TCR 20 - Beta Native *Homo sapiens* (nt) | |
| 1027 | TCR 21 - Alpha Native *Homo sapiens* (nt) | |
| 1028 | TCR 21 - Beta Native *Homo sapiens* (nt) | |
| 1029 | TCR 22 - Alpha Native *Homo sapiens* (nt) | |
| 1030 | TCR 22 - Beta Native *Homo sapiens* (nt) | |
| 1031 | TCR 23 - Alpha Native *Homo sapiens* (nt) | |
| 1032 | TCR 23 - Beta Native *Homo sapiens* (nt) | |
| 1033 | TCR 24 - Alpha Native *Homo sapiens* (nt) | |
| 1034 | TCR 24 - Beta Native *Homo sapiens* (nt) | |
| 1035 | TCR 25 - Alpha Native *Homo sapiens* (nt) | |
| 1036 | TCR 25 - Beta Native *Homo sapiens* (nt) | |
| 1037 | TCR 26 - Alpha Native *Homo sapiens* (nt) | |
| 1038 | TCR 26 - Beta Native *Homo sapiens* (nt) | |
| 1039 | TCR 27 - Alpha Native *Homo sapiens* (nt) | |
| 1040 | TCR 27 - Beta Native *Homo sapiens* (nt) | |
| 1041 | TCR 28 - Alpha Native *Homo sapiens* (nt) | |
| 1042 | TCR 28 - Beta Native *Homo sapiens* (nt) | |
| 1043 | TCR 29 - Alpha Native *Homo sapiens* (nt) | |
| 1044 | TCR 29 - Beta Native *Homo sapiens* (nt) | |
| 1045 | TCR 30 - Alpha Native *Homo sapiens* (nt) | |
| 1046 | TCR 30 - Beta Native *Homo sapiens* (nt) | |
| 1047 | Human TCR beta constant 2 (TRBC2) NCBI Reference Sequence: NG_001333.2, TRBC2 | |
| 1048 | TRAC gRNA targeting domain | |
| 1049 | TCR 32 - Alpha Native *Homo sapiens* (nt) | |
| 1050 | TCR 32-Beta Native *Homo sapiens* (nt) | |
| 1051 | TCR 33 - Alpha Native *Homo sapiens* (nt) | |
| 1052 | TCR 33 - Beta Native *Homo sapiens* (nt) | |
| 1053 | TRBC gRNA targeting domain | |
| 1054 | TRBC target sequence *Homo sapiens* (nt) | |
| 1055 | TCR 35 - Alpha Native *Homo sapiens* (nt) | |
| 1056 | TCR 35 - Beta Native *Homo sapiens* (nt) | |

-continued

SEQUENCE TABLE

| SEQ ID NO. | SEQUENCE | DESCRIPTION |
|---|---|---|
| 1057 | TCR 36 - Alpha Native *Homo sapiens* (nt) | |
| 1058 | TCR 36 - Beta Native *Homo sapiens* (nt) | |
| 1059 | TCR 37 - Alpha Native *Homo sapiens* (nt) | |
| 1060 | TCR 37 - Beta Native *Homo sapiens* (nt) | |
| 1061 | TCR 38 - Alpha Native *Homo sapiens* (nt) | |
| 1062 | TCR 38 - Beta Native *Homo sapiens* (nt) | |
| 1063 | TCR 39 - Alpha Native *Homo sapiens* (nt) | |
| 1064 | TCR 39 - Beta Native *Homo sapiens* (nt) | |
| 1065 | TCR 40 - Alpha Native *Homo sapiens* (nt) | |
| 1066 | TCR 40 - Beta Native *Homo sapiens* (nt) | |
| 1067 | TCR 41 - Alpha Native *Homo sapiens* (nt) | |
| 1068 | TCR 41 - Beta Native *Homo sapiens* (nt) | |
| 1069 | TCR 42- Alpha Native *Homo sapiens* (nt) | |
| 1070 | TCR 42 - Beta Native *Homo sapiens* (nt) | |
| 1071 | TCR 43 - Alpha Native *Homo sapiens* (nt) | |
| 1072 | TCR 43 - Beta Native *Homo sapiens* (nt) | |
| 1073 | TCR 44 - Alpha Native *Homo sapiens* (nt) | |
| 1074 | TCR 44 - Beta Native *Homo sapiens* (nt) | |
| 1075 | TCR 45 - Alpha Native *Homo sapiens* (nt) | |
| 1076 | TCR 45 - Beta Native *Homo sapiens* (nt) | |
| 1077 | TCR 46 - Alpha Native *Homo sapiens* (nt) | |
| 1078 | TCR 46 - Beta Native *Homo sapiens* (nt) | |
| 1079 | TCR 47 - Alpha Native *Homo sapiens* (nt) | |
| 1080 | TCR 47 - Beta Native *Homo sapiens* (nt) | |
| 1081 | TCR 48 - Alpha Native *Homo sapiens* (nt) | |
| 1082 | TCR 48 - Beta Native *Homo sapiens* (nt) | |
| 1083 | TCR 49 - Alpha Native *Homo sapiens* (nt) | |
| 1084 | TCR 49 - Beta Native *Homo sapiens* (nt) | |
| 1085 | TCR 50 - Alpha Native *Homo sapiens* (nt) | |
| 1086 | TCR 50 - Beta Native *Homo sapiens* (nt) | |
| 1087 | TCR 51 - Alpha Native *Homo sapiens* (nt) | |
| 1088 | TCR 51 - Beta Native *Homo sapiens* (nt) | |
| 1089 | TCR 52 - Alpha Native *Homo sapiens* (nt) | |
| 1090 | TCR 52 - Beta Native *Homo sapiens* (nt) | |
| 1091 | TCR 53- Alpha Native *Homo sapiens* (nt) | |
| 1092 | TCR 53 - Beta Native *Homo sapiens* (nt) | |

SEQUENCE TABLE

| SEQ ID NO. | SEQUENCE | DESCRIPTION |
|---|---|---|
| 1093 | TCR 54 - Alpha Native *Homo sapiens* (nt) | |
| 1094 | TCR 54 - Beta Native *Homo sapiens* (nt) | |
| 1095 | TCR 55 - Alpha Native *Homo sapiens* (nt) | |
| 1096 | TCR 50/TCR 54 P2A Artificial (nt) | |
| 1097 | TCR 15 Codon-optimized/cysteine-modified alpha *Homo sapiens* (nt) | |
| 1098 | TCR 15 Codon-optimized/cysteine-modified beta *Homo sapiens* (nt) | |
| 1099 | TCR 16 Codon-optimized/cysteine-modified alpha *Homo sapiens* (nt) | |
| 1100 | TCR 16 Codon-optimized/cysteine-modified beta *Homo sapiens* (nt) | |
| 1101 | TCR 17 Codon-optimized/cysteine-modified alpha *Homo sapiens* (nt) | |
| 1102 | TCR 17 Codon-optimized/cysteine-modified beta *Homo sapiens* (nt) | |
| 1103 | TCR 18 Codon-optimized/cysteine-modified alpha *Homo sapiens* (nt) | |
| 1104 | TCR 18 Codon-optimized/cysteine-modified beta *Homo sapiens* (nt) | |
| 1105 | TCR 19 Codon-optimized/cysteine-modified alpha *Homo sapiens* (nt) | |
| 1106 | TCR 19 Codon-optimized/cysteine-modified beta *Homo sapiens* (nt) | |
| 1107 | TCR 20 Codon-optimized/cysteine-modified alpha *Homo sapiens* (nt) | |
| 1108 | TCR 20 Codon-optimized/cysteine-modified beta *Homo sapiens* (nt) | |
| 1109 | TCR 21 Codon-optimized/cysteine-modified alpha *Homo sapiens* (nt) | |
| 1110 | TCR 21 Codon-optimized/cysteine-modified beta *Homo sapiens* (nt) | |
| 1111 | TCR 22 Codon-optimized/cysteine-modified alpha *Homo sapiens* (nt) | |
| 1112 | TCR 22 Codon-optimized/cysteine-modified beta *Homo sapiens* (nt) | |
| 1113 | TCR 23 Codon-optimized/cysteine-modified alpha *Homo sapiens* (nt) | |
| 1114 | TCR 23 Codon-optimized/cysteine-modified beta *Homo sapiens* (nt) | |
| 1115 | TCR 24 Codon-optimized/cysteine-modified alpha *Homo sapiens* (nt) | |
| 1116 | TCR 24 Codon-optimized/cysteine-modified beta *Homo sapiens* (nt) | |
| 1117 | TCR 25 Codon-optimized/cysteine-modified alpha *Homo sapiens* (nt) | |
| 1118 | TCR 25 Codon-optimized/cysteine-modified beta *Homo sapiens* (nt) | |
| 1119 | TCR 26 Codon-optimized/cysteine-modified alpha *Homo sapiens* (nt) | |
| 1120 | TCR 26 Codon-optimized/cysteine-modified beta *Homo sapiens* (nt) | |
| 1121 | TCR 27 Codon-optimized/cysteine-modified alpha *Homo sapiens* (nt) | |
| 1122 | TCR 27 Codon-optimized/cysteine-modified beta *Homo sapiens* (nt) | |
| 1123 | TCR 28 Codon-optimized/cysteine-modified alpha *Homo sapiens* (nt) | |
| 1124 | TCR 28 Codon-optimized/cysteine-modified beta *Homo sapiens* (nt) | |
| 1125 | TCR 29 Codon-optimized/cysteine-modified alpha *Homo sapiens* (nt) | |
| 1126 | TCR 29 Codon-optimized/cysteine-modified beta *Homo sapiens* (nt) | |
| 1127 | TCR 30 Codon-optimized/cysteine-modified alpha *Homo sapiens* (nt) | |
| 1128 | TCR 30 Codon-optimized/cysteine-modified beta *Homo sapiens* (nt) | |
| 1129 | TCR 31 Codon-optimized/cysteine-modified alpha *Homo sapiens* (nt) | |

SEQUENCE TABLE

| SEQ ID NO. | SEQUENCE | DESCRIPTION |
|---|---|---|
| 1130 | TCR 31 Codon-optimized/cysteine-modified beta *Homo sapiens* (nt) | |
| 1131 | TCR 32 Codon-optimized/cysteine-modified alpha *Homo sapiens* (nt) | |
| 1132 | TCR 32 Codon-optimized/cysteine-modified beta *Homo sapiens* (nt) | |
| 1133 | TCR 33 Codon-optimized/cysteine-modified alpha *Homo sapiens* (nt) | |
| 1134 | TCR 33 Codon-optimized/cysteine-modified beta *Homo sapiens* (nt) | |
| 1135 | TCR 34 Codon-optimized/cysteine-modified alpha *Homo sapiens* (nt) | |
| 1136 | TCR 34 Codon-optimized/cysteine-modified beta *Homo sapiens* (nt) | |
| 1137 | TCR 35 Codon-optimized/cysteine-modified alpha *Homo sapiens* (nt) | |
| 1138 | TCR 35 Codon-optimized/cysteine-modified beta *Homo sapiens* (nt) | |
| 1139 | TCR 36 Codon-optimized/cysteine-modified alpha *Homo sapiens* (nt) | |
| 1140 | TCR 36 Codon-optimized/cysteine-modified beta *Homo sapiens* (nt) | |
| 1141 | TCR 37 Codon-optimized/cysteine-modified alpha *Homo sapiens* (nt) | |
| 1142 | TCR 37 Codon-optimized/cysteine-modified beta *Homo sapiens* (nt) | |
| 1143 | TCR 38 Codon-optimized/cysteine-modified alpha *Homo sapiens* (nt) | |
| 1144 | TCR 38 Codon-optimized/cysteine-modified beta *Homo sapiens* (nt) | |
| 1145 | TCR 39 Codon-optimized/cysteine-modified alpha *Homo sapiens* (nt) | |
| 1146 | TCR 39 Codon-optimized/cysteine-modifiedbeta *Homo sapiens* (nt) | |
| 1147 | TCR 40 Codon-optimized/cysteine-modified alpha *Homo sapiens* (nt) | |
| 1148 | TCR 40 Codon-optimized/cysteine-modified beta *Homo sapiens* (nt) | |
| 1149 | TCR 41 Codon-optimized/cysteine-modified alpha *Homo sapiens* (nt) | |
| 1150 | TCR 41 Codon-optimized/cysteine-modified beta *Homo sapiens* (nt) | |
| 1151 | TCR 42 Codon-optimized/cysteine-modified alpha *Homo sapiens* (nt) | |
| 1152 | TCR 42 Codon-optimized/cysteine-modified beta *Homo sapiens* (nt) | |
| 1153 | TCR 43 Codon-optimized/cysteine-modified alpha *Homo sapiens* (nt) | |
| 1154 | TCR 43 Codon-optimized/cysteine-modified beta *Homo sapiens* (nt) | |
| 1155 | TCR 44 Codon-optimized/cysteine-modified alpha *Homo sapiens* (nt) | |
| 1156 | TCR 44 Codon-optimized/cysteine-modified beta *Homo sapiens* (nt) | |
| 1157 | TCR 45 Codon-optimized/cysteine-modified alpha *Homo sapiens* (nt) | |
| 1158 | TCR 45 Codon-optimized/cysteine-modified beta *Homo sapiens* (nt) | |
| 1159 | TCR 46 Codon-optimized/cysteine-modified alpha *Homo sapiens* (nt) | |
| 1160 | TCR 46 Codon-optimized/cysteine-modified beta *Homo sapiens* (nt) | |
| 1161 | TCR 47 Codon-optimized/cysteine-modified alpha *Homo sapiens* (nt) | |
| 1162 | TCR 47 Codon-optimized/cysteine-modified beta *Homo sapiens* (nt) | |
| 1163 | TCR 48 Codon-optimized/cysteine-modified alpha *Homo sapiens* (nt) | |
| 1164 | TCR 48 Codon-optimized/cysteine-modified beta *Homo sapiens* (nt) | |
| 1165 | TCR 49 Codon-optimized/cysteine-modified alpha *Homo sapiens* (nt) | |

| SEQUENCE TABLE | |
|---|---|
| SEQ ID NO. SEQUENCE | DESCRIPTION |
| 1166 TCR 49 Codon-optimized/cysteine-modified beta *Homo sapiens* (nt) | |
| 1167 TCR 50 Codon-optimized/cysteine-modified alpha *Homo sapiens* (nt) | |
| 1168 TCR 50 Codon-optimized/cysteine-modified beta *Homo sapiens* (nt) | |
| 1169 TCR 51 Codon-optimized/cysteine-modified alpha *Homo sapiens* (nt) | |
| 1170 TCR 51 Codon-optimized/cysteine-modified beta *Homo sapiens* (nt) | |
| 1171 TCR 52 Codon-optimized/cysteine-modified alpha *Homo sapiens* (nt) | |
| 1172 TCR 52 Codon-optimized/cysteine-modified beta *Homo sapiens* (nt) | |
| 1173 TCR 53 Codon-optimized/cysteine-modified alpha *Homo sapiens* (nt) | |
| 1174 TCR 53 Codon-optimized/cysteine-modified beta *Homo sapiens* (nt) | |
| 1175 TCR 54 Codon-optimized/cysteine-modified alpha *Homo sapiens* (nt) | |
| 1176 TCR 54 Codon-optimized/cysteine-modified beta *Homo sapiens* (nt) | |
| 1177 TCR 55 Codon-optimized/cysteine-modified alpha *Homo sapiens* (nt) | |
| 1178 TCR 55 Codon-optimized/cysteine-modified beta *Homo sapiens* (nt) | |
| 1179 TCR 15/TCR 16/TCR 17/TCR 18/TCR 19/TCR 20/TCR 21/TCR22/TCR 23/TCR 24/TCR 25/TCR 26/ TCR 27/TCR 28/TCR 29/TCR 30/TCR 31/TCR 32/TCR 33/TCR 34 P2A Artificial (nt) | |
| 1180 TCR 35/TCR 36/TCR 38/TCR 40/TCR 41/TCR 42/TCR 43/TCR 44/TCR 45/TCR 46/TCR 47/TCR 48 P2A Artificial (nt) | |
| 1181 TCR 37/TCR 39 P2A Artificial(nt) | |
| 1182 TRAC target sequence *Homo sapiens* (nt) | |
| 1183 TCR alpha E7(11-19) CDR3 consensus | |
| 1184 TCR alpha E7(11-19) CDR3 consensus | |
| 1185 TCR alpha E7(11-19) CDR3 consensus | |
| 1186 TCR alpha E7(11-19) CDR3 consensus | |
| 1187 TCR alpha E7(11-19) CDR3 consensus | |
| 1188 TCR alpha E7(11-19) CDR3 consensus | |
| 1189 TCR alpha E7(11-19) CDR3 consensus | |
| 1190 TCR alpha E7(11-19) CDR3 consensus | |
| 1191 TCR alpha E7(11-19) CDR1 consensus | |
| 1192 TCR alpha E7(11-19) CDR2 consensus | |
| 1193 TCR beta E7(11-19) CDR3 consensus | |
| 1194 TCR beta E7(11-19) CDR3 consensus | |
| 1195 TCR beta E7(11-19) CDR3 consensus | |
| 1196 TCR beta E7(11-19) CDR3 consensus | |
| 1197 TCR beta E7(11-19) CDR3 consensus | |
| 1198 TCR beta E7(11-19) CDR3 consensus | |
| 1199 TCR beta E7(11-19) CDR3 consensus | |
| 1200 TCR beta E7(11-19) CDR3 consensus | |
| 1201 TCR beta E7(11-19) CDR3 consensus | |

SEQUENCE TABLE

| SEQ ID NO. | SEQUENCE | DESCRIPTION |
|---|---|---|
| 1202 | TCR beta E7(11-19) CDR3 consensus | |
| 1203 | TCR beta E7(11-19) CDR1 consensus | |
| 1204 | TCR beta E7(11-19) CDR2consensus | |
| 1205 | TCR alpha E6(29-38) CDR3 consensus | |
| 1206 | TCR alpha E6(29-38) CDR3 consensus | |
| 1207 | TCR alpha E6(29-38) CDR3 consensus | |
| 1208 | TCR alpha E6(29-38) CDR3 consensus | |
| 1209 | TCR alpha E6(29-38) CDR1consensus | |
| 1210 | TCR alpha E6(29-38) CDR2consensus | |
| 1211 | TCR beta E6(29-38) CDR3 consensus | |
| 1212 | TCR beta E6(29-38) CDR3 consensus | |
| 1213 | TCR beta E6(29-38) CDR3 consensus | |
| 1214 | TCR beta E6(29-38) CDR3 consensus | |
| 1215 | TCR beta E6(29-38) CDR3 consensus | |
| 1216 | TCR beta E6(29-38) CDR3 consensus | |
| 1217 | TCR beta E6(29-38) CDR3 consensus | |
| 1218 | TCR beta E6(29-38) CDR1 consensus | |
| 1219 | TCR beta E6(29-38) CDR2 consensus | |
| 1220 | TCR beta E6(29-38) CDR3 consensus | |
| 1221 | TCR alphaE6(29-38) CDR3 consensus | |
| 1222 | TCR beta E6(29-38) CDR3 consensus | |
| 1223 | TCR beta E6(29-38) CDR3 consensus | |
| 1224 | TCR 31 - beta Native *Homo sapiens* (nt) | |
| 1225 | TCR 31 - Alpha Native *Homo sapiens* (nt) | |
| 1226 | TCR 34 - Alpha Native *Homo sapiens* (nt) | |
| 1227 | TCR 34 - Beta Native *Homo sapiens* (nt) | |
| 1228 | TCR 55 - Beta Native *Homo sapiens* (nt) | |
| 1229 | TRAC-10 | |
| 1230 | TRAC-110 | |
| 1231 | TRAC-116 | |
| 1232 | TRAC-4 | |
| 1233 | TRAC-49 | |
| 1234 | TRAC-2 | |
| 1235 | TRAC-30 | |
| 1236 | TRAC-43 | |
| 1237 | TRAC-23 | |

SEQUENCE TABLE

| SEQ ID NO. | SEQUENCE | DESCRIPTION |
|---|---|---|
| 1238 | TRAC-34 | |
| 1239 | TRAC-25 | |
| 1240 | TRAC-128 | |
| 1241 | TRAC-105 | |
| 1242 | TRAC-106 | |
| 1243 | TRAC-123 | |
| 1244 | TRAC-64 | |
| 1245 | TRAC-97 | |
| 1246 | TRAC-148 | |
| 1247 | TRAC-147 | |
| 1248 | TRAC-234 | |
| 1249 | TRAC-167 | |
| 1250 | TRAC-177 | |
| 1251 | TRAC-176 | |
| 1252 | TRAC-257 | |
| 1253 | TRAC-233 | |
| 1254 | TRAC-231 | |
| 1255 | TRAC-163 | |
| 1256 | TRAC-241 | |
| 1257 | TRAC-179 | |
| 1258 | TRAC-178 | |
| 1259 | TRBC-40 | |
| 1260 | TRBC-52 | |
| 1261 | TRBC-25 | |
| 1262 | TRBC-35 | |
| 1263 | TRBC-39 | |
| 1264 | TRBC-49 | |
| 1265 | TRBC-51 | |
| 1266 | TRBC-26 | |
| 1267 | TRBC-47 | |
| 1268 | TRBC-45 | |
| 1269 | TRBC-34 | |
| 1270 | TRBC-227 | |
| 1271 | TRBC-41 | |
| 1272 | TRBC-30 | |
| 1273 | TRBC-206 | |
| 1274 | TRBC-32 | |

-continued

SEQUENCE TABLE

| SEQ ID NO. | SEQUENCE | DESCRIPTION |
|---|---|---|
| 1275 | TRBC-276 | |
| 1276 | TRBC-274 | |
| 1277 | TRBC-230 | |
| 1278 | TRBC-235 | |
| 1279 | TRBC-38 | |
| 1280 | TRBC-223 | |
| 1281 | TRBC-221 | |
| 1282 | TRBC-48 | |
| 1283 | TRBC-216 | |
| 1284 | TRBC-210 | |
| 1285 | TRBC-268 | |
| 1286 | TRBC-193 | |
| 1287 | TRBC-246 | |
| 1288 | TRBC-228 | |
| 1289 | TRBC-43 | |
| 1290 | TRBC-272 | |
| 1291 | TRBC-33 | |
| 1292 | TRBC-44 | |
| 1293 | TRBC-211 | |
| 1294 | TRBC-253 | |
| 1295 | TRBC-18 | |
| 1296 | TRBC-6 | |
| 1297 | TRBC-85 | |
| 1298 | TRBC-129 | |
| 1299 | TRBC-93 | |
| 1300 | TRBC-415 | |
| 1301 | TRBC-414 | |
| 1302 | TRBC-310 | |
| 1303 | TRBC-308 | |
| 1304 | TRBC-401 | |
| 1305 | TRBC-468 | |
| 1306 | TRBC-462 | |
| 1307 | TRBC-424 | |
| 1308 | TRBC-423 | |
| 1309 | TRBC-422 | |
| 1310 | TRBC-420 | |

-continued

| SEQ ID NO. | SEQUENCE | DESCRIPTION |
|---|---|---|
| 1311 | TRBC-419 | |
| 1312 | TRBC-418 | |
| 1313 | TRBC-445 | |
| 1314 | TRBC-444 | |
| 1315 | TRBC-442 | |
| 1316 | exemplary gRNA | |
| 1317 | exemplary gRNA | |
| 1318 | exemplary gRNA | |
| 1319 | exemplary gRNA | |
| 1320 | exemplary gRNA | |
| 1321 | exemplary gRNA | |
| 1322 | exemplary gRNA | |
| 1323 | exemplary proximal and tail domains | |
| 1324 | exemplary proximal and tail domains | |
| 1325 | exemplary proximal and tail domains | |
| 1326 | exemplary proximal and tail domains | |
| 1327 | exemplary proximal and tail domains | |
| 1328 | exemplary proximal and tail domains | |
| 1329 | exemplary gRNA | |
| 1330 | exemplary gRNA | |
| 1331 | *S. mutans* Cas9 | |
| 1332 | *S. pyogenes* Cas9 | |
| 1333 | *S. thermophilus* Cas9 | |
| 1334 | *L. innocua* Cas9 | |
| 1335 | *N. meningitidis* Cas9 | |
| 1336 | *S. pyogenes* Cas9 | |
| 1337 | *S. pyogenes* Cas9 codon optimized nucleic acid sequence | |
| 1338 | *S. pyogenes* Cas9 | |
| 1339 | *N. meningitidis* Cas9 codon optimized nucleic acid sequence | |
| 1340 | *N. meningitidis* Cas9 | |
| 1341 | *S. aureus* Cas9 codon optimized nucleic acid sequence | |
| 1342 | *S. aureus* Cas9 | |
| 1343 | TRAC 5' homology arm | |
| 1344 | TRAC 3' homology arm | |
| 1345 | Ef1 alpha promoter with HTL VI enhancer | |
| 1346 | P2A nucleotide sequence | |
| 1347 | MND promoter | |

455
456
-continued

| SEQ ID NO. | SEQUENCE | DESCRIPTION |
|---|---|---|
| 1348 | Target sequence | |
| 1349 | Target sequence | |
| 1350 | exemplary gRNA | |
| 1351 | exemplary gRNA | |
| 1352 | Human TCR alpha constant (Uniprot P01848) | |
| 1353 | Human TCR beta constant 1 (Uniprot P01850) | |
| 1354 | Human TCR beta constant 2 (Uniprot A0A5B9) | |
| 1355 | Human TCRa. constant (Genbank Accession No. CAA26636.1) | |
| 1356 | Human TCR beta constant (Uniprot Accession No. A0A0G2JNG9) | |
| 1357 | Exemplary splice acceptor site | |
| 1358 | Exemplary splice acceptor site | |
| 1359 | EF1alpha promoter (GenBank: J04617.1) | |
| 1360 | EF1alpha promoter | |
| 1361 | MND promoter | |
| 1362 | Alpha Mouse constant region (aa) | |
| 1363 | Beta human constant region (aa) | |
| 1364 | Partial recombinant TCRα constant region exon 1 sequence | |
| 1365 | TCR alpha overall CDR3 consensus | |
| 1366 | TCR beta overall CDR3 consensus | |
| 1367 | TCR alpha overall CDR1 consensus | |
| 1368 | TCR beta overall CDR2 consensus | |
| 1369 | TCR beta overall CDR1 consensus | |
| 1370 | TCR alpha E6(29-38) CDR3 consensus | |
| 1371 | TCR alpha E6(29-38) CDR1 consensus | |
| 1372 | TCR alpha E6(29-38) CDR2 consensus | |
| 1373 | TCR beta E6(29-38) CDR3 consensus | |
| 1374 | TCR alpha E7(11-19) CDR3 consensus | |
| 1375 | TCR 66 Codon-optimized/cysteine-modified beta | |
| 1376 | TCR 66 - Beta Native | |
| 1377 | TCR 66 - Beta Cysteine-modified | |
| 1378 | TCR 66 - Beta Native | |
| 1379 | TCR 66 - Beta Cysteine-modified | |
| 1380 | TCR 66 - beta variable | |
| 1381 | TCR 66 Beta CDR3 | |
| 1382 | TCR 66 Codon-optimized/cysteine-modified full sequence | |
| 1383 | TCR 66 Full Sequence Native | |

SEQUENCE TABLE
_____
SEQ
ID
NO.   SEQUENCE                                                       DESCRIPTION
_____
1384  TCR 66 Full Sequence Cysteine modified 1385  TCR 66 Codon-optimized/cysteine-modified alpha 1386  TCR 66 - Alpha Native 1387  TCR 66 - Alpha Cysteine-modified 1388  TCR 66 - Alpha Native 1389  TCR 66 - Alpha Cysteine-modified 1390  TCR 66- Alpha variable 1391  TCR 66 - Alpha CDR3
_____

SEQUENCE LISTING (1391 sequences)

SEQ ID NO: 1 - protein, 606 aa, Homo sapiens
  TCR 14 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMEKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 2 - protein, 604 aa, Homo sapiens
  TCR 13 Full Sequence Cysteine-Modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLLLVPVLEVIFTLGGTRAQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 3 - protein, 606 aa, Homo sapiens
  TCR 12 / TCR 55Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 4 - DNA, 66 bp, Artificial Sequence
  TCR 14 P2A
ggctccggcgccacaaacttttctctgctgaagcaggcaggcgatgtggaggagaaccctggacca

SEQ ID NO: 5 - DNA, 66 bp, Artificial Sequence
  TCR 13 P2A
ggaagcggagccaccaacttttccctgctgaagcaggccggcgatgtggaggagaatcctggccca

SEQ ID NO: 6 - DNA, 66 bp, Artificial Sequence
  TCR 12 P2A
ggatctggagccaccaacttctccctgctgaagcaggccggcgatgtggaggagaatcctggccca

SEQ ID NO: 7 - DNA, 930 bp, Homo sapiens
  TCR 14 - Beta Codon-optimized / Cysteine-modified
atgggcatccggctgctgtgcagagtggccttctgttttctggccgtgggcctggtggacgtgaaggtgacccagagctcccggtatctggtgaagagaacaggcgagaaggtgtttctggagtgcgtgcaggacatggatcacgagaacatgttctggtacaggcaggatccaggcctgggcctgagactgatctatttcagctacgatgtgaagatgaaggagaagggcgacatccctgagggctattctgtgagcagggagaagaaggagcggttcagcctgatcctggagtccgcctctaccaaccagacatctatgtacctgtgcgcaagcaccttctggggacagaggagaacagaggccttctttggccagggcaccaggctgacagtggtggaggacctgaataaggtgttcccccctgaggtggccgtgtttgagccatccgaggccgagatctctcacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgatagccgctattgtctgtctagcaggctgcgcgtgtccgccaccttttggcagaacccaaggaatcacttccgctgccaggtgcagttttacggcctgtccgagaatgacgagtggacccaggatagggccaagccagtgacacagatcgtgtctgccgaggcatggggcagagccgactgtggcttcaccagcgtgtcctaccagcagggcgtgctgagcgccaccatcctgtatgagatcctgctgggcaaggccacactgtacgccgtgctggtgtccgccctggtgctgatggccatggtgaagcggaaggacttc

SEQ ID NO: 8 - DNA, 936 bp, Homo sapiens
  TCR 13 - Beta Codon-optimized / cysteine-modified
atgggaaccaggctgctgtgctgggtggtgctgggctttctgggaaccgaccacacaggagcaggcgtgtcccagtctccaaggtacaaggtggccaagagaggccaggatgtggccctgagatgtgaccccatctccggccacgtgtctctgttctggtaccagcaggccctgggacagggaccagagttcctgacatattttcagaacgaggcccagctggataagagcggcctgccttccgacaggttctttgcagagcgcccagagggaagcgtgtccaccctgaagatccagaggacacagcaggaggactccgccgtgtacctgtgcgcaagctcccctaccggaacagagagggagctgttctttggagagggcagccgcctgaccgtgctggaggatctgaagaacgtgttcccccctgaggtggccgtgtttgagcctagcgaggccgagatctcccacacccagaaggccaccctggtgtgcctggcaaccggcttctatccagaccacgtggagctgagctggtgggtgaacggcaaggaggtgcactccggcgtgtgcacagacccacagcccctgaaggagcagcccgccctgaatgatagccgctactgtctgtctagccggctgagagtgtccgccaccttttggcagaaccctaggaatcacttccgctgccaggtgcagttttatggcctgtccgagaacgacgagtggacccaggatcgggccaagcccgtgacacagatcgtgtctgccgaggcatggggcagagccgattgtggcttcacatctgagagctaccagcagggcgtgctgtccgccaccatcctgtacgagatcctgctgggcaaggccacactgtatgccgtgctggtgagcgccctggtgctgatggccatggtgaagaggaaggactctagagga

SEQ ID NO: 9 - DNA, 933 bp, Homo sapiens
  TCR 12 - Beta Codon-optimized / cysteine-modified
atggacacctggctggtgtgctgggccatcttcagcctgctgaaggcaggcctgaccgagcctgaggtgacccagacaccatcccaccaggtgacacagatgggccaggaagtgatcctgcggtgcgtgcctatctccaaccacctgtacttttattggtacagacagatcctgggccagaaggtggagtttctggtgagcttctacaacaatgagatcagcgagaagtccgagatctttgacgatcagttctctgtggagaggcccgacggcagcaacttcaccctgaagatccgctccacaaagctggaggattctgccatgtatttctgcgccagcaccacacggagctcctacgagcagtattttggccctggcaccagactgaccgtgacagaggacctgaagaacgtgttcccccctgaggtggccgtgttcgagccatctgaggccgagatcagccacacccagaaggccaccctggtgtgcctggcaaccggcttctaccccgatcacgtggagctgagctggtgggtgaacggcaaggaggtgcactccggcgtgtgcacagacccacagcccctgaaggagcagcctgccctgaatgatagcagatactgtctgtctagccggctgagagtgtccgccaccttctggcagaacccaaggaatcactttcgctgccaggtgcagttctatggcctgtctgagaacgacgagtggacccaggatagggccaagccagtgacacagatcgtgagcgccgaggcatggggcagagccgattgtggctttacaagcgagtcctatcagcagggcgtgctgtccgccaccatcctgtacgagatcctgctgggcaaggccacactgtatgccgtgctggtgtctgccctggtgctgatggccatggtgaagaggaaggactccagagga

SEQ ID NO: 10 - DNA, 825 bp, Homo sapiens
  TCR 14 - Alpha Codon-optimized / Cysteine-modified
atggagaagaatcctctggccgccccactgctgatcctgtggttccacctggactgcgtgtcctctatcctgaatgtggagcagagcccacagtccctgcacgtgcaggagggcgatagcaccaacttcacatgttcctttcctagctccaacttctacgccctgcactggtaccggtgggagacagccaagagcccagaggccctgttcgtgatgacactgaacggcgacgagaagaagaagggcagaatcagcgccaccctgaatacaaaggagggctactcctatctgtacatcaagggcagccagcccgaggattccgccacctacctgtgcgcctcccagacaggcgccaacaatctgttctttggcaccggcacaaggctgaccgtgatcccttatatccagaacccagaccctgccgtgtaccagctgagggactctaagtctagcgataagagcgtgtgcctgttcaccgactttgattctcagacaaacgtgagccagagcaaggacagcgacgtgtacatcaccgacaagtgcgtgctggatatgagaagcatggactttaagtccaactctgccgtggcctggtctaataagagcgatttcgcctgcgccaacgcctttaacaattccatcatccccgaggatacattctttccatctcccgagtcctcttgtgacgtgaagctggtggagaagagcttcgagacagatacaaacctgaattttcagaacctgagcgtgatcggcttccggatcctgctgctgaaggtggccggcttcaatctgctgatgaccctgagactgtggagctcctga

SEQ ID NO: 11 - DNA, 813 bp, Homo sapiens
  TCR 13 - Alpha Codon-optimized / cysteine-modified
atgctgctgctgctggtgccagtgctggaagtgatcttcaccctgggaggaacaagggcacagtctgtgacccagctggacagccacgtgtccgtgtctgagggcacacccgtgctgctgagatgcaactactcctctagctatagcccctccctgttttggtacgtgcagcaccctaataagggcctgcagctgctgctgaagtatacctccgccgccacactggtgaagggcatcaatggcttcgaggccgagtttaagaagagcgagacaagcttccacctgacaaagccttccgcccacatgtctgacgccgccgagtacttttgcgtggtgcggggaggcaagctgatcttcggacagggaaccgagctgagcgtgaagccaaacatccagaatcccgatcctgccgtgtatcagctgcgcgactccaagtcctctgataagagcgtgtgcctgttcaccgactttgattctcagacaaacgtgtctcagagcaaggacagcgacgtgtacatcaccgacaagtgcgtgctggatatgcggagcatggactttaagtccaactctgccgtggcctggtctaataagagcgatttcgcctgcgccaatgcctttaacaattccatcatccccgaggatacattctttccatctcccgagagctcctgtgacgtgaagctggtggagaagagcttcgagacagatacaaacctgaattttcagaacctgagcgtgatcggcttcaggatcctgctgctgaaggtggccggcttcaatctgctgatgaccctgcgcctgtggtctagctga

SEQ ID NO: 12 - DNA, 822 bp, Homo sapiens
  TCR 12 - Alpha Codon-optimized / Cysteine-modified
atgaagacatttgccggcttctcttttctgttcctgtggctgcagctggattgcatgagcaggggcgaggacgtggagcagagcctgttcctgtccgtgcgcgagggcgattcctctgtgatcaactgtacctacacagacagctcctctacctatctgtactggtataagcaggagccaggagcaggcctgcagctgctgacctatatcttttccaacatggacatgaagcaggatcagcggctgacagtgctgctgaataagaaggacaagcacctgagcctgagaatcgctgacacccagacaggcgattccgccatctacttctgcgccgtgccctctggcgccaccaataagctgatctttggaaccggcacactgctggcagtgcagcctaacatccagaatcccgatcctgccgtgtaccagctgcgggacagcaagagctccgataagtccgtgtgcctgtttaccgacttcgattctcagacaaacgtgtctcagagcaaggacagcgacgtgtacatcaccgacaagtgcgtgctggatatgcggagcatggacttcaagtccaactctgccgtggcctggtctaataagagcgactttgcctgcgccaatgccttcaacaattccatcatccccgaggatacattctttccatctcccgagtctagctgtgacgtgaagctggtggagaagagcttcgagacagatacaaacctgaatttccagaacctgtctgtgatcggctttaggatcctgctgctgaaggtggccggctttaatctgctgatgaccctgcgcctgtggtcctcttga

SEQ ID NO: 13 - DNA, 1821 bp, Homo sapiens
  TCR 14 Codon-optimized / cysteine-modified full sequence
atgggcatccggctgctgtgcagagtggccttctgttttctggccgtgggcctggtggacgtgaaggtgacccagagctcccggtatctggtgaagagaacaggcgagaaggtgtttctggagtgcgtgcaggacatggatcacgagaacatgttctggtacaggcaggatccaggcctgggcctgagactgatctatttcagctacgatgtgaagatgaaggagaagggcgacatccctgagggctattctgtgagcagggagaagaaggagcggttcagcctgatcctggagtccgcctctaccaaccagacatctatgtacctgtgcgcaagcaccttctggggacagaggagaacagaggccttctttggccagggcaccaggctgacagtggtggaggacctgaataaggtgttcccccctgaggtggccgtgtttgagccatccgaggccgagatctctcacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgatagccgctattgtctgtctagcaggctgcgcgtgtccgccaccttttggcagaacccaaggaatcacttccgctgccaggtgcagttttacggcctgtccgagaatgacgagtggacccaggatagggccaagccagtgacacagatcgtgtctgccgaggcatggggcagagccgactgtggcttcaccagcgtgtcctaccagcagggcgtgctgagcgccaccatcctgtatgagatcctgctgggcaaggccacactgtacgccgtgctggtgtccgccctggtgctgatggccatggtgaagcggaaggacttcggctccggcgccacaaacttttctctgctgaagcaggcaggcgatgtggaggagaaccctggaccaatggagaagaatcctctggccgccccactgctgatcctgtggttccacctggactgcgtgtcctctatcctgaatgtggagcagagcccacagtccctgcacgtgcaggagggcgatagcaccaacttcacatgttcctttcctagctccaacttctacgccctgcactggtaccggtgggagacagccaagagcccagaggccctgttcgtgatgacactgaacggcgacgagaagaagaagggcagaatcagcgccaccctgaatacaaaggagggctactcctatctgtacatcaagggcagccagcccgaggattccgccacctacctgtgcgcctcccagacaggcgccaacaatctgttctttggcaccggcacaaggctgaccgtgatcccttatatccagaacccagaccctgccgtgtaccagctgagggactctaagtctagcgataagagcgtgtgcctgttcaccgactttgattctcagacaaacgtgagccagagcaaggacagcgacgtgtacatcaccgacaagtgcgtgctggatatgagaagcatggactttaagtccaactctgccgtggcctggtctaataagagcgatttcgcctgcgccaacgcctttaacaattccatcatccccgaggatacattctttccatctcccgagtcctcttgtgacgtgaagctggtggagaagagcttcgagacagatacaaacctgaattttcagaacctgagcgtgatcggcttccggatcctgctgctgaaggtggccggcttcaatctgctgatgaccctgagactgtggagctcctga

SEQ ID NO: 14 - DNA, 1815 bp, Homo sapiens
  TCR 13 Codon-optimized / Cysteine-modified Full Sequence
atgggaaccaggctgctgtgctgggtggtgctgggctttctgggaaccgaccacacaggagcaggcgtgtcccagtctccaaggtacaaggtggccaagagaggccaggatgtggccctgagatgtgaccccatctccggccacgtgtctctgttctggtaccagcaggccctgggacagggaccagagttcctgacatattttcagaacgaggcccagctggataagagcggcctgccttccgacaggttctttgcagagcgcccagagggaagcgtgtccaccctgaagatccagaggacacagcaggaggactccgccgtgtacctgtgcgcaagctcccctaccggaacagagagggagctgttctttggagagggcagccgcctgaccgtgctggaggatctgaagaacgtgttcccccctgaggtggccgtgtttgagcctagcgaggccgagatctcccacacccagaaggccaccctggtgtgcctggcaaccggcttctatccagaccacgtggagctgagctggtgggtgaacggcaaggaggtgcactccggcgtgtgcacagacccacagcccctgaaggagcagcccgccctgaatgatagccgctactgtctgtctagccggctgagagtgtccgccaccttttggcagaaccctaggaatcacttccgctgccaggtgcagttttatggcctgtccgagaacgacgagtggacccaggatcgggccaagcccgtgacacagatcgtgtctgccgaggcatggggcagagccgattgtggcttcacatctgagagctaccagcagggcgtgctgtccgccaccatcctgtacgagatcctgctgggcaaggccacactgtatgccgtgctggtgagcgccctggtgctgatggccatggtgaagaggaaggactctagaggaggaagcggagccaccaacttttccctgctgaagcaggccggcgatgtggaggagaatcctggcccaatgctgctgctgctggtgccagtgctggaagtgatcttcaccctgggaggaacaagggcacagtctgtgacccagctggacagccacgtgtccgtgtctgagggcacacccgtgctgctgagatgcaactactcctctagctatagcccctccctgttttggtacgtgcagcaccctaataagggcctgcagctgctgctgaagtatacctccgccgccacactggtgaagggcatcaatggcttcgaggccgagtttaagaagagcgagacaagcttccacctgacaaagccttccgcccacatgtctgacgccgccgagtacttttgcgtggtgcggggaggcaagctgatcttcggacagggaaccgagctgagcgtgaagccaaacatccagaatcccgatcctgccgtgtatcagctgcgcgactccaagtcctctgataagagcgtgtgcctgttcaccgactttgattctcagacaaacgtgtctcagagcaaggacagcgacgtgtacatcaccgacaagtgcgtgctggatatgcggagcatggactttaagtccaactctgccgtggcctggtctaataagagcgatttcgcctgcgccaatgcctttaacaattccatcatccccgaggatacattctttccatctcccgagagctcctgtgacgtgaagctggtggagaagagcttcgagacagatacaaacctgaattttcagaacctgagcgtgatcggcttcaggatcctgctgctgaaggtggccggcttcaatctgctgatgaccctgcgcctgtggtctagctga

SEQ ID NO: 15 - DNA, 1821 bp, Homo sapiens
  TCR 12 Codon-optimized / Cysteine-modified Full Sequence
atggacacctggctggtgtgctgggccatcttcagcctgctgaaggcaggcctgaccgagcctgaggtgacccagacaccatcccaccaggtgacacagatgggccaggaagtgatcctgcggtgcgtgcctatctccaaccacctgtacttttattggtacagacagatcctgggccagaaggtggagtttctggtgagcttctacaacaatgagatcagcgagaagtccgagatctttgacgatcagttctctgtggagaggcccgacggcagcaacttcaccctgaagatccgctccacaaagctggaggattctgccatgtatttctgcgccagcaccacacggagctcctacgagcagtattttggccctggcaccagactgaccgtgacagaggacctgaagaacgtgttcccccctgaggtggccgtgttcgagccatctgaggccgagatcagccacacccagaaggccaccctggtgtgcctggcaaccggcttctaccccgatcacgtggagctgagctggtgggtgaacggcaaggaggtgcactccggcgtgtgcacagacccacagcccctgaaggagcagcctgccctgaatgatagcagatactgtctgtctagccggctgagagtgtccgccaccttctggcagaacccaaggaatcactttcgctgccaggtgcagttctatggcctgtctgagaacgacgagtggacccaggatagggccaagccagtgacacagatcgtgagcgccgaggcatggggcagagccgattgtggctttacaagcgagtcctatcagcagggcgtgctgtccgccaccatcctgtacgagatcctgctgggcaaggccacactgtatgccgtgctggtgtctgccctggtgctgatggccatggtgaagaggaaggactccagaggaggatctggagccaccaacttctccctgctgaagcaggccggcgatgtggaggagaatcctggcccaatgaagacatttgccggcttctcttttctgttcctgtggctgcagctggattgcatgagcaggggcgaggacgtggagcagagcctgttcctgtccgtgcgcgagggcgattcctctgtgatcaactgtacctacacagacagctcctctacctatctgtactggtataagcaggagccaggagcaggcctgcagctgctgacctatatcttttccaacatggacatgaagcaggatcagcggctgacagtgctgctgaataagaaggacaagcacctgagcctgagaatcgctgacacccagacaggcgattccgccatctacttctgcgccgtgccctctggcgccaccaataagctgatctttggaaccggcacactgctggcagtgcagcctaacatccagaatcccgatcctgccgtgtaccagctgcgggacagcaagagctccgataagtccgtgtgcctgtttaccgacttcgattctcagacaaacgtgtctcagagcaaggacagcgacgtgtacatcaccgacaagtgcgtgctggatatgcggagcatggacttcaagtccaactctgccgtggcctggtctaataagagcgactttgcctgcgccaatgccttcaacaattccatcatccccgaggatacattctttccatctcccgagtctagctgtgacgtgaagctggtggagaagagcttcgagacagatacaaacctgaatttccagaacctgtctgtgatcggctttaggatcctgctgctgaaggtggccggctttaatctgctgatgaccctgcgcctgtggtcctcttga

SEQ ID NO: 16 - DNA, 933 bp, Homo sapiens
  TCR 14 - Beta Native
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcaccttctggggacagcgaaggactgaagctttctttggacaaggcaccagactcacagttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctga

SEQ ID NO: 17 - DNA, 939 bp, Homo sapiens
  TCR 13 - Beta Native
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcccgacagggactgagagggagctgttttttggagaaggctctaggctgaccgtactggaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 18 - protein, 255 aa, Homo sapiens
  TCR 3 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 19 - protein, 255 aa, Homo sapiens
  TCR 3 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 20 - DNA, 816 bp, Homo sapiens
  TCR 3 - Alpha Native
atgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagaggggcgaggcttcaaaactatctttggagcaggaacaagactatttgttaaagcaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 21 - DNA, 825 bp, Homo sapiens
  TCR 3 - Alpha Codon-optimized / Cysteine-modified
atgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagaggggcgaggcttcaaaactatctttggagcaggaacaagactatttgttaaagcaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcc

SEQ ID NO: 22 - protein, 294 aa, Homo sapiens
  TCR 3 - Beta Native
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 23 - protein, 294 aa, Homo sapiens
  TCR 3 - Beta Cysteine-modified
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 24 - DNA, 939 bp, Homo sapiens
  TCR 3 - Beta Native
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagccacctcgccgggttcaccggggagctgttttttggagaaggctctaggctgaccgtactggaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 25 - DNA, 939 bp, Homo sapiens
  TCR 3 - Beta Codon-optimized / Cysteine-modified
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagccacctcgccgggttcaccggggagctgttttttggagaaggctctaggctgaccgtactggaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 26 - DNA, 1853 bp, Homo sapiens
  TCR 3 Codon-optimized / Cysteine-modified Full Sequence
gcggccgccaccatgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagccacctcgccgggttcaccggggagctgttttttggagaaggctctaggctgaccgtactggaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcggatccggagctaccaacttctctctgctgaaacaggcaggcgatgtggaggaaaatcctgggccaatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagaggggcgaggcttcaaaactatctttggagcaggaacaagactatttgttaaagcaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcctaaggcgcgcc

SEQ ID NO: 27 - protein, 610 aa, Homo sapiens
  TCR 3 Full Sequence Cysteine-modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 28 - protein, 254 aa, Homo sapiens
  TCR 4 - (E6) 29 Alpha Native
DAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 29 - protein, 254 aa, Homo sapiens
  TCR 4 - (E6)29 Alpha Cysteine-modified
DAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 30 - DNA, 804 bp, Homo sapiens
  TCR 4 - (E6)29 Alpha Native
atgaagttggtgacaagcattactgtactcctatctttgggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctactggtaatccgtggtactagctatggaaagctgacatttggacaagggaccatcttgactgtccatccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 31 - DNA, 813 bp, Homo sapiens
  TCR 4 - (E6)29 Alpha Codon-optimized / Cysteine-modified
atgaaactggtgaccagcatcacagtcctgctgtccctgggaattatgggcgacgccaagaccacacagcctaactctatggagagtaatgaggaagagcctgtgcacctgccatgtaaccattcaactatcagcggcaccgattacattcactggtatcggcagctgccctcccagggacctgaatacgtgatccatggcctgacctcaaatgtcaacaatcgcatggctagcctggctatcgcagaggaccgaaagtcaagcaccctgattctgcaccgagccacactgcgagatgcagccgtgtactattgcatcctgctggtcattagagggaccagctacggaaaactgacatttggccaggggactatcctgaccgtgcatcctaacattcagaatcccgaccctgccgtgtatcagctgagggactctaagtcctctgataaaagcgtgtgcctgttcactgactttgattcccagaccaacgtgtcccagtctaaggactctgacgtgtacatcacagacaaatgcgtcctggatatgcgcagcatggacttcaagagtaactcagccgtggcttggtccaacaagtctgatttcgcatgcgccaacgcttttaacaacagtatcatcccagaagataccttctttccatcacccgagagttcatgtgacgtgaagctggtcgaaaaatctttcgagactgataccaacctgaattttcagaacctgagtgtgatcgggttcaggattctgctgctgaaggtcgccggattcaatctgctgatgacactgcgcctgtggagctcc

SEQ ID NO: 32 - protein, 291 aa, Homo sapiens
  TCR 4 - (E6)29 Beta Native
DTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 33 - protein, 291 aa, Homo sapiens
  TCR 4 - (E6)29 Beta Cysteine-modified
DTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 34 - DNA, 930 bp, Homo sapiens
  TCR 4 - (E6)29 Beta Native
atgggcaccagcctcctctgctggatggccctgtgtctcctgggggcagatcacgcagatactggagtctcccaggaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagccccggcggggggaacactgaagctttctttggacaaggcaccagactcacagttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 35 - DNA, 930 bp, Homo sapiens
  TCR 4 - (E6)29 Beta  Codon-optimized / Cysteine-modified
atggggactagcctgctgtgctggatggcactgtgcctgctgggagcagaccacgcagataccggagtgagccaggacccaagacataagatcacaaaaaggggccagaacgtgacttttagatgcgatcccattagcgaacacaatagactgtactggtataggcagacactgggacagggaccagagttcctgacttactttcagaacgaagctcagctggagaagagtcgcctgctgtcagaccggttcagcgccgagcgaccaaaaggctctttcagtacactggaaatccagcgaactgagcagggggattccgccatgtatctgtgcgctagctccccaggaggaggaaacaccgaagccttctttggacagggcacacggctgactgtggtcgaggacctgaataaggtgttcccccctgaagtggccgtctttgagccttccgaagctgagatttctcacacccagaaagccaccctggtgtgcctggcaacaggcttctttccagatcacgtggaactgagctggtgggtcaacggaaaggaggtgcatagcggcgtctgcactgacccacagcccctgaaagagcagcccgcactgaatgatagcaggtactgcctgtctagtcggctgagagtgtccgccaccttttggcagaaccctaggaatcatttccgctgtcaggtgcagttttatggcctgtccgaaaacgacgagtggactcaggatcgggccaagcccgtgacccagatcgtctctgcagaagcctggggcagagctgactgcgggttcacctcagtgagctaccagcagggagtcctgtccgctaccatcctgtacgagattctgctgggcaaggctacactgtatgcagtgctggtctctgcactggtgctgatggccatggtcaagcgcaaagacttc

SEQ ID NO: 36 - DNA, 1832 bp, Homo sapiens
  TCR 4 - (E6)29  Codon-optimized / Cysteine-modified Full Sequence
gcggccgccaccatggggactagcctgctgtgctggatggcactgtgcctgctgggagcagaccacgcagataccggagtgagccaggacccaagacataagatcacaaaaaggggccagaacgtgacttttagatgcgatcccattagcgaacacaatagactgtactggtataggcagacactgggacagggaccagagttcctgacttactttcagaacgaagctcagctggagaagagtcgcctgctgtcagaccggttcagcgccgagcgaccaaaaggctctttcagtacactggaaatccagcgaactgagcagggggattccgccatgtatctgtgcgctagctccccaggaggaggaaacaccgaagccttctttggacagggcacacggctgactgtggtcgaggacctgaataaggtgttcccccctgaagtggccgtctttgagccttccgaagctgagatttctcacacccagaaagccaccctggtgtgcctggcaacaggcttctttccagatcacgtggaactgagctggtgggtcaacggaaaggaggtgcatagcggcgtctgcactgacccacagcccctgaaagagcagcccgcactgaatgatagcaggtactgcctgtctagtcggctgagagtgtccgccaccttttggcagaaccctaggaatcatttccgctgtcaggtgcagttttatggcctgtccgaaaacgacgagtggactcaggatcgggccaagcccgtgacccagatcgtctctgcagaagcctggggcagagctgactgcgggttcacctcagtgagctaccagcagggagtcctgtccgctaccatcctgtacgagattctgctgggcaaggctacactgtatgcagtgctggtctctgcactggtgctgatggccatggtcaagcgcaaagacttcgggagtggagcaacaaacttttcactgctgaagcaggccggcgatgtggaggaaaatcctgggccaatgaaactggtgaccagcatcacagtcctgctgtccctgggaattatgggcgacgccaagaccacacagcctaactctatggagagtaatgaggaagagcctgtgcacctgccatgtaaccattcaactatcagcggcaccgattacattcactggtatcggcagctgccctcccagggacctgaatacgtgatccatggcctgacctcaaatgtcaacaatcgcatggctagcctggctatcgcagaggaccgaaagtcaagcaccctgattctgcaccgagccacactgcgagatgcagccgtgtactattgcatcctgctggtcattagagggaccagctacggaaaactgacatttggccaggggactatcctgaccgtgcatcctaacattcagaatcccgaccctgccgtgtatcagctgagggactctaagtcctctgataaaagcgtgtgcctgttcactgactttgattcccagaccaacgtgtcccagtctaaggactctgacgtgtacatcacagacaaatgcgtcctggatatgcgcagcatggacttcaagagtaactcagccgtggcttggtccaacaagtctgatttcgcatgcgccaacgcttttaacaacagtatcatcccagaagataccttctttccatcacccgagagttcatgtgacgtgaagctggtcgaaaaatctttcgagactgataccaacctgaattttcagaacctgagtgtgatcgggttcaggattctgctgctgaaggtcgccggattcaatctgctgatgacactgcgcctgtggagctcctgaggcgcgcc

SEQ ID NO: 37 - protein, 603 aa, Homo sapiens
  TCR 4 - (E6)29 Full Sequence Cysteine-modified
MGTSLLCWMALCLLGADHADTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 38 - protein, 258 aa, Homo sapiens
  TCR 5 - (E6)29 - TCR Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 39 - protein, 258 aa, Homo sapiens
  TCR 5 - (E6)29 - TCR Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 40 - DNA, 825 bp, Homo sapiens
  TCR 5 - (E6)29 - TCR Alpha Native
atgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagagggcacaggtactagctatggaaagctgacatttggacaagggaccatcttgactgtccatccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 41 - DNA, 834 bp, Homo sapiens
  TCR 5 - (E6)29 - TCR Alpha Codon-optimized / Cysteine-modified
atgagtctgtcctctctgctgaaggtggtcactgcatcactgtggctgggaccaggaatcgcacagaaaattacccagacacagcctggcatgtttgtccaggagaaggaagccgtgaccctggactgtacttacgacaccagcgatcagtcctacgggctgttttggtataagcagccaagttcaggagagatgatcttcctgatctaccagggcagctatgacgagcagaacgctacagaaggcaggtatagcctgaatttccagaaagcccgcaagtccgctaacctggtcatctctgccagtcagctgggggattctgccatgtacttttgcgctatgagggagggaactggcaccagctatggaaagctgaccttcgggcagggaacaatcctgactgtccatcccaacattcagaatccagaccctgccgtgtaccagctgcgagacagtaaaagctccgataagagcgtgtgcctgttcacagactttgattctcagactaacgtgagccagagcaaagacagtgatgtctatattaccgacaagtgcgtgctggatatgcgcagcatggactttaaatccaactctgcagtggcctggtctaataagagtgatttcgcttgcgcaaacgcctttaacaattcaatcattcccgaggataccttctttccaagccccgaatctagttgtgacgtgaaactggtggagaagtctttcgaaacagatactaacctgaattttcagaatctgagtgtcatcgggttccggattctgctgctgaaggtggccggattcaacctgctgatgaccctgagactgtggtcaagc

SEQ ID NO: 42 - protein, 291 aa, Homo sapiens
  TCR 5 - (E6)29 - TCR Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 43 - protein, 291 aa, Homo sapiens
  TCR 5 - (E6)29 - TCR Beta  Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 44 - DNA, 930 bp, Homo sapiens
  TCR 5 - (E6)29 - TCR Beta Native
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagcccatggggagaaactcatcagccccagcattttggtgatgggactcgactctccatcctagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 45 - DNA, 930 bp, Homo sapiens
  TCR 5 - (E6)29 - TCR Beta Codon-optimized / Cysteine-modified
atgggaatcaggctgctgtgccgcgtcgcattctgttttctggccgtgggcctggtggacgtgaaagtgactcagagctccagatacctggtgaaaaggaccggcgagaaggtctttctggaatgcgtgcaggacatggatcacgagaatatgttctggtatcggcaggatccaggcctggggctgagactgatctacttttcctatgatgtgaagatgaaagagaagggcgacattcccgaagggtactccgtgtctcgcgagaagaaagaacgattcagcctgatcctggagagtgcttcaaccaatcagacatccatgtatctgtgcgcatctagtccttggggcgagacacaccagccacagcatttcggagatggcactcggctgagcatcctggaagacctgaacaaagtgttcccccctgaggtcgccgtgttcgaaccttcagaggcagaaattagccacactcagaaggccaccctggtgtgcctggccactggcttctttccagaccacgtcgagctgtcctggtgggtgaatgggaaagaagtccatagtggagtgtgcaccgacccacagcccctgaaggagcagcccgcactgaacgattccagatactgcctgtcaagccggctgagagtgtctgccactttttggcagaaccctcgaaatcatttccggtgtcaggtgcagttttatggcctgagcgagaacgacgaatggacccaggatcgagccaaacctgtcacacagatcgtgtccgccgaggcttggggacgcgctgattgcggcttcacaagcgtctcctaccagcagggcgtgctgtctgccaccatcctgtacgaaattctgctggggaaggctacactgtatgccgtgctggtgagcgccctggtgctgatggcaatggtgaaaaggaaggacttc

SEQ ID NO: 46 - DNA, 1853 bp, Homo sapiens
  TCR 5 - (E6)29 - TCR Codon-optimized / Cysteine-modified Full Sequence
gcggccgccaccatgggaatcaggctgctgtgccgcgtcgcattctgttttctggccgtgggcctggtggacgtgaaagtgactcagagctccagatacctggtgaaaaggaccggcgagaaggtctttctggaatgcgtgcaggacatggatcacgagaatatgttctggtatcggcaggatccaggcctggggctgagactgatctacttttcctatgatgtgaagatgaaagagaagggcgacattcccgaagggtactccgtgtctcgcgagaagaaagaacgattcagcctgatcctggagagtgcttcaaccaatcagacatccatgtatctgtgcgcatctagtccttggggcgagacacaccagccacagcatttcggagatggcactcggctgagcatcctggaagacctgaacaaagtgttcccccctgaggtcgccgtgttcgaaccttcagaggcagaaattagccacactcagaaggccaccctggtgtgcctggccactggcttctttccagaccacgtcgagctgtcctggtgggtgaatgggaaagaagtccatagtggagtgtgcaccgacccacagcccctgaaggagcagcccgcactgaacgattccagatactgcctgtcaagccggctgagagtgtctgccactttttggcagaaccctcgaaatcatttccggtgtcaggtgcagttttatggcctgagcgagaacgacgaatggacccaggatcgagccaaacctgtcacacagatcgtgtccgccgaggcttggggacgcgctgattgcggcttcacaagcgtctcctaccagcagggcgtgctgtctgccaccatcctgtacgaaattctgctggggaaggctacactgtatgccgtgctggtgagcgccctggtgctgatggcaatggtgaaaaggaaggacttcgggtccggagccacaaatttttctctgctgaaacaggctggcgatgtggaggaaaaccctgggccaatgagtctgtcctctctgctgaaggtggtcactgcatcactgtggctgggaccaggaatcgcacagaaaattacccagacacagcctggcatgtttgtccaggagaaggaagccgtgaccctggactgtacttacgacaccagcgatcagtcctacgggctgttttggtataagcagccaagttcaggagagatgatcttcctgatctaccagggcagctatgacgagcagaacgctacagaaggcaggtatagcctgaatttccagaaagcccgcaagtccgctaacctggtcatctctgccagtcagctgggggattctgccatgtacttttgcgctatgagggagggaactggcaccagctatggaaagctgaccttcgggcagggaacaatcctgactgtccatcccaacattcagaatccagaccctgccgtgtaccagctgcgagacagtaaaagctccgataagagcgtgtgcctgttcacagactttgattctcagactaacgtgagccagagcaaagacagtgatgtctatattaccgacaagtgcgtgctggatatgcgcagcatggactttaaatccaactctgcagtggcctggtctaataagagtgatttcgcttgcgcaaacgcctttaacaattcaatcattcccgaggataccttctttccaagccccgaatctagttgtgacgtgaaactggtggagaagtctttcgaaacagatactaacctgaattttcagaatctgagtgtcatcgggttccggattctgctgctgaaggtggccggattcaacctgctgatgaccctgagactgtggtcaagctgaggcgcgcc

SEQ ID NO: 47 - protein, 610 aa, Homo sapiens
  TCR 5 - (E6)29 - TCR Full Sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 48 - protein, 253 aa, Homo sapiens
  TCR 6 - Alpha Native
GEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 49 - protein, 253 aa, Homo sapiens
  TCR 6 - Alpha Cysteine-modified
GEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 50 - DNA, 813 bp, Homo sapiens
  TCR 6 - Alpha Native
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagtataagaggctttgggaatgtgctgcattgcgggtccggcactcaagtgattgttttaccacatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 51 - DNA, 822 bp, Homo sapiens
  TCR 6 - Alpha Codon-optimized / Cysteine-modified
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagtataagaggctttgggaatgtgctgcattgcgggtccggcactcaagtgattgttttaccacatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcc

SEQ ID NO: 52 - protein, 292 aa, Homo sapiens
  TCR 6, TCR 12 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 53 - protein, 292 aa, Homo sapiens
  TCR 6, TCR 12  - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 54 - DNA, 933 bp, Homo sapiens
  TCR 6 - Beta Codon Optimized / Cysteine Modified
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaacgaggagctcctacgagcagtacttcgggccgggcaccaggctcacggtcacagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtctgcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 55 - DNA, 933 bp, Homo sapiens
  TCR 6 - Beta Native
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaacgaggagctcctacgagcagtacttcgggccgggcaccaggctcacggtcacagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 56 - DNA, 1844 bp, Homo sapiens
  TCR 6 Codon-optimized / Cysteine-modified Full Sequence
gcggccgccaccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaacgaggagctcctacgagcagtacttcgggccgggcaccaggctcacggtcacagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtctgcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcggatccggagctaccaacttctctctgctgaaacaggcaggcgatgtggaggaaaatcctgggccaatgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagtataagaggctttgggaatgtgctgcattgcgggtccggcactcaagtgattgttttaccacatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcctaaggcgcgcc

SEQ ID NO: 57 - protein, 607 aa, Homo sapiens
  TCR 6 Full Sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 58 - protein, 254 aa, Homo sapiens
  TCR 7/ TCR 54 - (E7)11 - Alpha  Native
KNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 59 - protein, 254 aa, Homo sapiens
  TCR 7/ TCR 54 - (E7)11 - Alpha Cysteine-modified
KNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 60 - DNA, 816 bp, Homo sapiens
  TCR 7 - (E7)11 - Alpha Native
atgaaaaagcatctgacgaccttcttggtgattttgtggctttatttttatagggggaatggcaaaaaccaagtggagcagagtcctcagtccctgatcatcctggagggaaagaactgcactcttcaatgcaattatacagtgagccccttcagcaacttaaggtggtataagcaagatactgggagaggtcctgtttccctgacaatcatgactttcagtgagaacacaaagtcgaacggaagatatacagcaactctggatgcagacacaaagcaaagctctctgcacatcacagcctcccagctcagcgattcagcctcctacatctgtgtggtgagccgggataactatggtcagaattttgtctttggtcccggaaccagattgtccgtgctgccctatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 61 - DNA, 825 bp, Homo sapiens
  TCR 7 - (E7)11 - Alpha  Codon-optimized / Cysteine-modified
atgaagaaacacctgaccaccttcctggtcatcctgtggctgtacttctacagagggaacggaaagaatcaggtggaacagagtccacagtcactgatcattctggagggcaaaaactgcactctgcagtgtaattataccgtgagcccattttccaatctgcgatggtacaagcaggacactggacgaggacccgtgagcctgaccattatgacattctccgagaacaccaagtctaatggccgctatacagccactctggacgctgatactaaacagtctagtctgcatatcaccgcctctcagctgtctgatagtgcttcatatatttgcgtggtcagtagggacaactacgggcagaatttcgtgtttggaccaggaacccgactgtccgtcctgccttatatccagaaccccgaccctgccgtgtaccagctgagggactctaagtcaagcgataaaagcgtgtgcctgttcacagactttgattcccagactaatgtgagccagtccaaggactctgacgtgtacattactgacaaatgcgtcctggatatgcgcagcatggactttaagtctaacagtgcagtggcctggtctaacaagagtgatttcgcttgcgcaaacgcctttaacaatagtatcattcccgaagatactttctttccatcacccgagtcctcttgtgacgtgaagctggtcgaaaaatcattcgagaccgatacaaacctgaattttcagaacctgtctgtgatcgggttccggattctgctgctgaaggtcgccggattcaatctgctgatgacactgagactgtggagttca

SEQ ID NO: 62 - protein, 290 aa, Homo sapiens
  TCR 7/ TCR 54 - (E7)11 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 63 - protein, 290 aa, Homo sapiens
  TCR 7/ TCR 54 - (E7)11 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 64 - DNA, 927 bp, Homo sapiens
  TCR 7 - (E7)11 -Beta Native
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccattacagaccgcactaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 65 - DNA, 927 bp, Homo sapiens
  TCR 7 - (E7)11 - Beta Codon-optimized / Cysteine-modified
atggacacctggctggtgtgctgggcaatctttagtctgctgaaggccggactgaccgagcctgaagtgactcagaccccatcccaccaggtcacacagatgggccaggaagtgatcctgcggtgcgtgccaatttccaaccatctgtacttctattggtacagacagattctgggccagaaggtggagttcctggtcagcttttataacaacgagatctcagaaaagagcgagattttcgacgatcagttttcagtggaaagacccgatgggagcaatttcaccctgaagatcaggagtacaaaactggaggattcagcaatgtacttttgcgccattactgaccgcaccaactatggatacaccttcggctccgggacacgactgactgtggtcgaggacctgaataaggtgttcccccctgaagtggctgtctttgagccttcagaggcagaaatcagccacacacagaaagccaccctggtgtgcctggctacaggcttctttccagatcacgtggaactgagctggtgggtcaacggcaaggaggtgcattccggggtctgcactgacccacagcccctgaaagagcagcccgctctgaatgatagcaggtattgcctgagctcccggctgagagtgtccgccaccttttggcagaaccctaggaatcatttccgctgtcaggtgcagttttacggcctgtctgaaaacgacgagtggacccaggatcgagctaagcctgtgacacagatcgtcagcgccgaagcttgggggcgcgcagactgcggattcaccagcgtgtcctaccagcagggcgtcctgtccgccacaatcctgtatgagattctgctggggaaggctactctgtacgcagtgctggtctctgctctggtgctgatggcaatggtcaagcggaaagacttc

SEQ ID NO: 66 - DNA, 1841 bp, Homo sapiens
  TCR 7 - (E7)11 - Codon-optimized / Cysteine-modified Full Sequence
gcggccgccaccatggacacctggctggtgtgctgggcaatctttagtctgctgaaggccggactgaccgagcctgaagtgactcagaccccatcccaccaggtcacacagatgggccaggaagtgatcctgcggtgcgtgccaatttccaaccatctgtacttctattggtacagacagattctgggccagaaggtggagttcctggtcagcttttataacaacgagatctcagaaaagagcgagattttcgacgatcagttttcagtggaaagacccgatgggagcaatttcaccctgaagatcaggagtacaaaactggaggattcagcaatgtacttttgcgccattactgaccgcaccaactatggatacaccttcggctccgggacacgactgactgtggtcgaggacctgaataaggtgttcccccctgaagtggctgtctttgagccttcagaggcagaaatcagccacacacagaaagccaccctggtgtgcctggctacaggcttctttccagatcacgtggaactgagctggtgggtcaacggcaaggaggtgcattccggggtctgcactgacccacagcccctgaaagagcagcccgctctgaatgatagcaggtattgcctgagctcccggctgagagtgtccgccaccttttggcagaaccctaggaatcatttccgctgtcaggtgcagttttacggcctgtctgaaaacgacgagtggacccaggatcgagctaagcctgtgacacagatcgtcagcgccgaagcttgggggcgcgcagactgcggattcaccagcgtgtcctaccagcagggcgtcctgtccgccacaatcctgtatgagattctgctggggaaggctactctgtacgcagtgctggtctctgctctggtgctgatggcaatggtcaagcggaaagacttcggaagcggcgcaacaaacttttccctgctgaaacaggccggagatgtggaggaaaatcctggcccaatgaagaaacacctgaccaccttcctggtcatcctgtggctgtacttctacagagggaacggaaagaatcaggtggaacagagtccacagtcactgatcattctggagggcaaaaactgcactctgcagtgtaattataccgtgagcccattttccaatctgcgatggtacaagcaggacactggacgaggacccgtgagcctgaccattatgacattctccgagaacaccaagtctaatggccgctatacagccactctggacgctgatactaaacagtctagtctgcatatcaccgcctctcagctgtctgatagtgcttcatatatttgcgtggtcagtagggacaactacgggcagaatttcgtgtttggaccaggaacccgactgtccgtcctgccttatatccagaaccccgaccctgccgtgtaccagctgagggactctaagtcaagcgataaaagcgtgtgcctgttcacagactttgattcccagactaatgtgagccagtccaaggactctgacgtgtacattactgacaaatgcgtcctggatatgcgcagcatggactttaagtctaacagtgcagtggcctggtctaacaagagtgatttcgcttgcgcaaacgcctttaacaatagtatcattcccgaagatactttctttccatcacccgagtcctcttgtgacgtgaagctggtcgaaaaatcattcgagaccgatacaaacctgaattttcagaacctgtctgtgatcgggttccggattctgctgctgaaggtcgccggattcaatctgctgatgacactgagactgtggagttcatgaggcgcgcc

SEQ ID NO: 67 - protein, 606 aa, Homo sapiens
  TCR 7/ TCR 54 - (E7)11 - Full Sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 68 - protein, 253 aa, Homo sapiens
  TCR 8 - Alpha Native
KQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 69 - protein, 253 aa, Homo sapiens
  TCR 8 - Alpha  Cysteine-modified
KQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 70 - DNA, 807 bp, Homo sapiens
  TCR 8 - Alpha Native
atggagaccctcttgggcctgcttatcctttggctgcagctgcaatgggtgagcagcaaacaggaggtgacacagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgaggcctctcggaaacacacctcttgtctttggaaagggcacaagactttctgtgattgcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctc

SEQ ID NO: 71 - DNA, 816 bp, Homo sapiens
  TCR 8 - Alpha  Codon-optimized / Cysteine-modified
atggagaccctcttgggcctgcttatcctttggctgcagctgcaatgggtgagcagcaaacaggaggtgacacagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgaggcctctcggaaacacacctcttgtctttggaaagggcacaagactttctgtgattgcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgcgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctctggtcttcc

SEQ ID NO: 72 - protein, 291 aa, Homo sapiens
  TCR 8 - Beta Native
KVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 73 - protein, 291 aa, Homo sapiens
  TCR 8 - Beta Cysteine-modified
KVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 74 - DNA, 936 bp, Homo sapiens
  TCR 8 - Beta Native
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggggctagcacagatacgcagtattttggcccaggcacccggctgacagtgctcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 75 - DNA, 936 bp, Homo sapiens
  TCR 8 - Beta Codon-optimized / Cysteine-modified
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggggctagcacagatacgcagtattttggcccaggcacccggctgacagtgctcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 76 - DNA, 1841 bp, Homo sapiens
  TCR 8 Codon-optimized / Cysteine-modified Full Sequence
gcggccgccaccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggggctagcacagatacgcagtattttggcccaggcacccggctgacagtgctcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcggatccggagctaccaacttctctctgctgaaacaggcaggcgatgtggaggaaaatcctgggccaatggagaccctcttgggcctgcttatcctttggctgcagctgcaatgggtgagcagcaaacaggaggtgacacagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgaggcctctcggaaacacacctcttgtctttggaaagggcacaagactttctgtgattgcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgcgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctctggtcttcctaaggcgcgcc

SEQ ID NO: 77 - protein, 606 aa, Homo sapiens
  TCR 8 Full Sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 78 - protein, 258 aa, Homo sapiens
  TCR 9 - Alpha Native
AQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 79 - protein, 258 aa, Homo sapiens
  TCR 9 - Alpha Cysteine-modified
AQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 80 - DNA, 825 bp, Homo sapiens
  TCR 9 - Alpha Native
atgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatccaagttatggtctattctggtacaagcagcccagcagtggggaaatgatttttcttatttatcaggggtcttatgaccagcaaaatgcaacagaaggtcgctactcattgaatttccagaaggcaagaaaatccgccaaccttgtcatctccgcttcacaactgggggactcagcaatgtacttctgtgcaatgagaactgctggtggtactagctatggaaagctgacatttggacaagggaccatcttgactgtccatccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 81 - DNA, 834 bp, Homo sapiens
  TCR 9 - Alpha Codon-optimized / Cysteine-modified
atgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatccaagttatggtctattctggtacaagcagcccagcagtggggaaatgatttttcttatttatcaggggtcttatgaccagcaaaatgcaacagaaggtcgctactcattgaatttccagaaggcaagaaaatccgccaaccttgtcatctccgcttcacaactgggggactcagcaatgtacttctgtgcaatgagaactgctggtggtactagctatggaaagctgacatttggacaagggaccatcttgactgtccatccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcc

SEQ ID NO: 82 - protein, 292 aa, Homo sapiens
  TCR 9 - Beta Native
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 83 - protein, 292 aa, Homo sapiens
  TCR 9 - Beta Cysteine-modified
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 84 - DNA, 933 bp, Homo sapiens
  TCR 9 - Beta Native
atgagcctcgggctcctgtgctgtggggccttttctctcctgtgggcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttacttcgggacagcctacgagcagtacttcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 85 - DNA, 933 bp, Homo sapiens
  TCR 9 - Beta Codon-optimized / Cysteine-modified
atgagcctcgggctcctgtgctgtggggccttttctctcctgtgggcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttacttcgggacagcctacgagcagtacttcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 86 - DNA, 1856 bp, Homo sapiens
  TCR 9 - Codon-optimized / Cysteine-modified Full Sequence
gcggccgccaccatgagcctcgggctcctgtgctgtggggccttttctctcctgtgggcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttacttcgggacagcctacgagcagtacttcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcggatccggagctaccaacttctctctgctgaaacaggcaggcgatgtggaggaaaatcctgggccaatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatccaagttatggtctattctggtacaagcagcccagcagtggggaaatgatttttcttatttatcaggggtcttatgaccagcaaaatgcaacagaaggtcgctactcattgaatttccagaaggcaagaaaatccgccaaccttgtcatctccgcttcacaactgggggactcagcaatgtacttctgtgcaatgagaactgctggtggtactagctatggaaagctgacatttggacaagggaccatcttgactgtccatccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcctaaggcgcgcc

SEQ ID NO: 87 - protein, 611 aa, Homo sapiens
  TCR 9 - Full Sequence Cysteine-modified
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 88 - protein, 258 aa, Homo sapiens
  TCR 10 - Alpha Native
RKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 89 - protein, 258 aa, Homo sapiens
  TCR 10 - Alpha Cysteine-modified
RKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 90 - DNA, 831 bp, Homo sapiens
  TCR 10 - Alpha Native
atgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacttcccttctcggggtgctggtggtactagctatggaaagctgacatttggacaagggaccatcttgactgtccatccaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 91 - DNA, 840 bp, Homo sapiens
  TCR 10 - Alpha Codon-optimized / Cysteine-modified
atgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacttcccttctcggggtgctggtggtactagctatggaaagctgacatttggacaagggaccatcttgactgtccatccaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcc

SEQ ID NO: 92 - protein, 291 aa, Homo sapiens
  TCR 10 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 93 - protein, 291 aa, Homo sapiens
  TCR 10 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 94 - DNA, 930 bp, Homo sapiens
  TCR 10 - Beta Native
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatccctaacagggaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 95 - DNA, 930 bp, Homo sapiens
  TCR 10 - Beta Codon-optimized / Cysteine-modified
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatccctaacagggaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtctgtacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 96 - DNA, 1859 bp, Homo sapiens
  TCR 10 Codon-optimized / Cysteine-modified Full Sequence
gcggccgccaccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatccctaacagggaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtctgtacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttcggatccggagctaccaacttctctctgctgaaacaggcaggcgatgtggaggaaaatcctgggccaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacttcccttctcggggtgctggtggtactagctatggaaagctgacatttggacaagggaccatcttgactgtccatccaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcctaaggcgcgcc

SEQ ID NO: 97 - protein, 612 aa, Homo sapiens
  TCR 10 Full Sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 98 - protein, 253 aa, Homo sapiens
  TCR 11 - Alpha Native
DAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 99 - protein, 253 aa, Homo sapiens
  TCR 11 - Alpha Cysteine-modified
DAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 100 - DNA, 801 bp, Homo sapiens
  TCR 11 - Alpha Native
atgaagttggtgacaagcattactgtactcctatctttgggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagcgctcactcaaattccgggtatgcactcaacttcggcaaaggcacctcgctgttggtcacaccccatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 101 - DNA, 810 bp, Homo sapiens
  TCR 11 - Alpha Codon-optimized / Cysteine-modified
atgaagttggtgacaagcattactgtactcctatctttgggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagcgctcactcaaattccgggtatgcactcaacttcggcaaaggcacctcgctgttggtcacaccccatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcc

SEQ ID NO: 102 - protein, 297 aa, Homo sapiens
  TCR 11 - Beta Native
SAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 103 - protein, 297 aa, Homo sapiens
  TCR 11 - Beta Cysteine-modified
SAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 104 - DNA, 936 bp, Homo sapiens
  TCR 11 - Beta Native
atgctgagtcttctgctccttctcctgggactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgtcccttggacgcgcggggggagcacagatacgcagtattttggcccaggcacccggctgacagtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 105 - DNA, 936 bp, Homo sapiens
  TCR 11 - Beta Codon-optimized / Cysteine-modified
atgctgagtcttctgctccttctcctgggactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgtcccttggacgcgcggggggagcacagatacgcagtattttggcccaggcacccggctgacagtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 106 - DNA, 1835 bp, Homo sapiens
  TCR 11 Codon-optimized / Cysteine-modified Full Sequence
gcggccgccaccatgctgagtcttctgctccttctcctgggactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgtcccttggacgcgcggggggagcacagatacgcagtattttggcccaggcacccggctgacagtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcggatccggagctaccaacttctctctgctgaaacaggcaggcgatgtggaggaaaatcctgggccaatgaagttggtgacaagcattactgtactcctatctttgggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagcgctcactcaaattccgggtatgcactcaacttcggcaaaggcacctcgctgttggtcacaccccatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcctaaggcgcgcc

SEQ ID NO: 107 - protein, 604 aa, Homo sapiens
  TCR 11 Full Sequence Cysteine-modified
MLSLLLLLLGLGSVFSAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 108 - DNA, 936 bp, Homo sapiens
  TCR 12 - Beta Native
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaacgaggagctcctacgagcagtacttcgggccgggcaccaggctcacggtcacagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 109 - protein, 172 aa, Mus musculus
  Mouse Beta Constant Sequence
DLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYHQGVLSATILYEILLGKATLYAVLVSGLVLMAMVKRKNS

SEQ ID NO: 110 - protein, 312 aa, Homo sapiens
  TCR 8 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 111 - protein, 114 aa, Homo sapiens
  TCR 3 Alpha Variable Region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKA

SEQ ID NO: 112 - protein, 115 aa, Homo sapiens
  TCR 3 Beta Variable Region
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVL

SEQ ID NO: 113 - protein, 113 aa, Homo sapiens
  TCR 4 - (E6)29 Alpha Variable Region
DAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHP

SEQ ID NO: 114 - protein, 112 aa, Homo sapiens
  TCR 4 - (E6)29 Beta Variable Region
GVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVV

SEQ ID NO: 115 - protein, 117 aa, Homo sapiens
  TCR 5 - (E6)29 - TCR Alpha Variable Region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHP

SEQ ID NO: 116 - protein, 112 aa, Homo sapiens
  TCR 5 - (E6)29 - TCR Beta Variable Region
KVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSIL

SEQ ID NO: 117 - protein, 112 aa, Homo sapiens
  TCR 6 Alpha Variable Region
GEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLP

SEQ ID NO: 118 - protein, 113 aa, Homo sapiens
  TCR 6, TCR 12 Beta Variable Region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVT

SEQ ID NO: 119 - protein, 113 aa, Homo sapiens
  TCR 7/ TCR 54 - (E7)11 - Alpha Variable Region
KNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLP

SEQ ID NO: 120 - protein, 113 aa, Homo sapiens
  TCR 7/ TCR 54 - (E7)11 - Beta Variable Region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVV

SEQ ID NO: 121 - protein, 112 aa, Homo sapiens
  TCR 8 Alpha Variable Region
KQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIA

SEQ ID NO: 122 - protein, 112 aa, Homo sapiens
  TCR 8 Beta Variable Region
KVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVL

SEQ ID NO: 123 - protein, 117 aa, Homo sapiens
  TCR 9 Alpha Variable Region
AQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHP

SEQ ID NO: 124 - protein, 113 aa, Homo sapiens
  TCR 9 Beta Variable Region
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVT

SEQ ID NO: 125 - protein, 117 aa, Homo sapiens
  TCR 10 Alpha Variable Region
RKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHP

SEQ ID NO: 126 - protein, 112 aa, Homo sapiens
  TCR 10 Beta Variable Region
KVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVV

SEQ ID NO: 127 - protein, 112 aa, Homo sapiens
  TCR 11 Alpha Variable Region
DAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTP

SEQ ID NO: 128 - protein, 118 aa, Homo sapiens
  TCR 11 Beta Variable Region
SAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVL

SEQ ID NO: 129 - protein, 312 aa, Homo sapiens
  TCR 8 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 130 - protein, 278 aa, Homo sapiens
  TCR 9 - Alpha Native
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 131 - protein, 278 aa, Homo sapiens
  TCR 9 - Alpha Cysteine-modified
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 132 - protein, 311 aa, Homo sapiens
  TCR 9 - Beta Native
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 133 - protein, 311 aa, Homo sapiens
  TCR 9 - Beta Cysteine-modified
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 134 - protein, 280 aa, Homo sapiens
  TCR 10 - Alpha Native
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 135 - protein, 280 aa, Homo sapiens
  TCR 10 - Alpha Cysteine-modified
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 136 - protein, 7 aa, Homo sapiens
  TCR 3/ TCR 5/ TCR 15 / TCR 19 / TCR 21 / TCR 23 / TCR 24 / TCR 25 / TCR 26 / TCR 29 - (E6)29 - TCR Alpha CDR1
TSDQSYG

SEQ ID NO: 137 - protein, 8 aa, Homo sapiens
  TCR 3/ TCR 5/ TCR 15 / TCR 19 / TCR 21 / TCR 23 / TCR 25  / TCR 26 / TCR 29 - (E6)29  - TCR Alpha CDR2
QGSYDEQN

SEQ ID NO: 138 - protein, 11 aa, Homo sapiens
  TCR 3 Alpha CDR3
AMREGRGFKTI

SEQ ID NO: 139 - protein, 5 aa, Homo sapiens
  TCR 3 / TCR 13/ TCR 37/ TCR 53 Beta CDR1
SGHVS

SEQ ID NO: 140 - protein, 6 aa, Homo sapiens
  TCR 3/ TCR 4/ TCR 13/ TCR 37 - (E6)29 Beta CDR2
FQNEAQ

SEQ ID NO: 141 - protein, 13 aa, Homo sapiens
  TCR 3 Beta CDR3
ASSHLAGFTGELF

SEQ ID NO: 142 - protein, 7 aa, Homo sapiens
  TCR 4/ TCR 27 - (E6)29/ TCR 11 Alpha CDR1
TISGTDY

SEQ ID NO: 143 - protein, 5 aa, Homo sapiens
  TCR 4/ TCR 27 - (E6)29/ TCR 11 Alpha CDR2
GLTSN

SEQ ID NO: 144 - protein, 14 aa, Homo sapiens
  TCR 4 - (E6)29 Alpha CDR3
ILLVIRGTSYGKLT

SEQ ID NO: 145 - protein, 5 aa, Homo sapiens
  TCR 4 - (E6)29 Beta CDR1
SEHNR

SEQ ID NO: 146 - protein, 12 aa, Homo sapiens
  TCR 4 - (E6)29 Beta CDR3
ASSPGGGNTEAF

SEQ ID NO: 147 - protein, 14 aa, Homo sapiens
  TCR 5 - (E6)29 - TCR Alpha CDR3
AMREGTGTSYGKLT

SEQ ID NO: 148 - protein, 5 aa, Homo sapiens
  TCR 5/ TCR 16/ TCR 17 /TCR 18 /TCR 19 / TCR 23 /TCR 24 /TCR 25 /TCR 28 - (E6)29/ TCR 8 /  TCR 10 / TCR 14 - TCR Beta CDR1
MDHEN

SEQ ID NO: 149 - protein, 6 aa, Homo sapiens
  TCR 5/ TCR 16/ TCR 17/ TCR 18/ TCR 19 / TCR 23/ TCR 24/ TCR 25/ TCR 28- (E6)29 / TCR 8 / TCR 10 / TCR 14 - TCR beta CDR2
SYDVKM

SEQ ID NO: 150 - protein, 13 aa, Homo sapiens
  TCR 5 - (E6)29 - TCR Beta CDR3
ASSPWGETHQPQH

SEQ ID NO: 151 - protein, 6 aa, Homo sapiens
  TCR 6, TCR 12, TCR 50, TCR 55 Alpha CDR1
DSSSTY

SEQ ID NO: 152 - protein, 7 aa, Homo sapiens
  TCR 6, TCR 12, TCR 50, TCR 55 Alpha CDR2
IFSNMDM

SEQ ID NO: 153 - protein, 12 aa, Homo sapiens
  TCR 6 Alpha CDR3
AESIRGFGNVLH

SEQ ID NO: 154 - protein, 5 aa, Homo sapiens
  TCR 6/ TCR 7 - (E7)11, E7(11-19) / TCR 12 Consensus, TCR 30 / TCR 33 / TCR 36 / TCR 39 /TCR 40 / TCR 41 / TCR 42 / TCR 43 / TCR 47 / TCR 48 / TCR 49 / TCR 51 / TCR 54/ TCR 55/TCR 66 Beta CDR1
SNHLY

SEQ ID NO: 155 - protein, 6 aa, Homo sapiens
  TCR 6/ TCR 7 - (E7)11, E7(11-19) / TCR 12 Consensus, TCR 30 / TCR 33 / TCR 36 / TCR 39 / TCR 42 / TCR 43  / TCR 47 / TCR 48 / TCR 49 / TCR 51 / TCR 54/ TCR 55/TCR 66 Beta CDR2
FYNNEI

SEQ ID NO: 156 - protein, 11 aa, Homo sapiens
  TCR 6 / TCR 12/ TCR 55 Beta CDR3
ASTTRSSYEQY

SEQ ID NO: 157 - protein, 6 aa, Homo sapiens
  TCR 7/ TCR 54 Alpha CDR1
VSPFSN

SEQ ID NO: 158 - protein, 7 aa, Homo sapiens
  TCR 7/ TCR 54 - (E7)11 - Alpha CDR2
MTFSENT

SEQ ID NO: 159 - protein, 12 aa, Homo sapiens
  TCR 7/ TCR 54 - (E7)11 - Alpha CDR3
VVSRDNYGQNFV

SEQ ID NO: 160 - protein, 11 aa, Homo sapiens
  TCR 7/ TCR 54 - (E7)11 - Beta CDR3
AITDRTNYGYT

SEQ ID NO: 161 - protein, 6 aa, Homo sapiens
  TCR 8/ TCR 16 / TCR 18 Alpha CDR1
DSAIYN

SEQ ID NO: 162 - protein, 7 aa, Homo sapiens
  TCR 8/ TCR 16 / TCR 18 Alpha CDR2
IQSSQRE

SEQ ID NO: 163 - protein, 11 aa, Homo sapiens
  TCR 8 Alpha CDR3
AVRPLGNTPLV

SEQ ID NO: 164 - protein, 13 aa, Homo sapiens
  TCR 8 Beta CDR3
ASSLWGASTDTQY

SEQ ID NO: 165 - protein, 7 aa, Homo sapiens
  TCR 9 / TCR 17 Alpha CDR1
TSDPSYG

SEQ ID NO: 166 - protein, 8 aa, Homo sapiens
  TCR 9 / TCR 17 Alpha CDR2
QGSYDQQN

SEQ ID NO: 167 - protein, 14 aa, Homo sapiens
  TCR 9 Alpha CDR3
AMRTAGGTSYGKLT

SEQ ID NO: 168 - protein, 5 aa, Homo sapiens
  TCR 9/ TCR 26 Beta CDR1
MNHEY

SEQ ID NO: 169 - protein, 6 aa, Homo sapiens
  TCR 9/ TCR 26 Beta CDR2
SVGEGT

SEQ ID NO: 170 - protein, 12 aa, Homo sapiens
  TCR 9 Beta CDR3
ASSYFGTAYEQY

SEQ ID NO: 171 - protein, 6 aa, Homo sapiens
  TCR 10/ TCR 28/ TCR 36/ TCR 41/ TCR 66 Alpha CDR1
NSASQS

SEQ ID NO: 172 - protein, 6 aa, Homo sapiens
  TCR 10/ TCR 28/ TCR 41/ TCR 66 Alpha CDR2
VYSSGN

SEQ ID NO: 173 - protein, 18 aa, Homo sapiens
  TCR 10 Alpha CDR3
VVNFPSRGAGGTSYGKLT

SEQ ID NO: 174 - protein, 13 aa, Homo sapiens
  TCR 10 Beta CDR3
ASSLSLTGNYGYT

SEQ ID NO: 175 - protein, 13 aa, Homo sapiens
  TCR 11 Alpha CDR3
ILSAHSNSGYALN

SEQ ID NO: 176 - protein, 5 aa, Homo sapiens
  TCR 11 Beta CDR1
SQVTM

SEQ ID NO: 177 - protein, 7 aa, Homo sapiens
  TCR 11 Beta CDR2
ANQGSEA

SEQ ID NO: 178 - protein, 15 aa, Homo sapiens
  TCR 11 Beta CDR3
SVVPWTRGGSTDTQY

SEQ ID NO: 179 - protein, 310 aa, Homo sapiens
  TCR 10 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 180 - protein, 310 aa, Homo sapiens
  TCR 10 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 181 - protein, 20 aa, Homo sapiens
  TCR 3/ TCR 9/ TCR 5/ TCR 15/ TCR 17/ TCR 19/ TCR 21/ TCR 23/ TCR 24/ TCR 25/ TCR 26/ TCR 29 - (E6)29 TCR Alpha Signal Peptide
MSLSSLLKVVTASLWLGPGI

SEQ ID NO: 182 - protein, 19 aa, Homo sapiens
  TCR 3 / TCR 13/ TCR 37  - Beta Signal Peptide
MGTRLLCWVVLGFLGTDHT

SEQ ID NO: 183 - DNA, 810 bp, Homo sapiens
  TCR 12 - Alpha Native
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagtcccctcgggtgctacaaacaagctcatctttggaactggcactctgcttgctgtccagccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgcgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 184 - protein, 17 aa, Homo sapiens
  TCR 4/ TCR 27 - (E6)29 Alpha Signal Peptide
MKLVTSITVLLSLGIMG

SEQ ID NO: 185 - protein, 21 aa, Homo sapiens
  TCR 4 - (E6)29 Beta Signal Peptide
MGTSLLCWMALCLLGADHADT

SEQ ID NO: 186 - protein, 19 aa, Homo sapiens
  TCR 5/ TCR 16/ TCR 17 / TCR 18/ TCR 19/ TCR 23/ TCR 24/ TCR 25/ TCR 28 - (E6)29/ TCR 8/ TCR10 / TCR 14 - TCR Beta Signal Peptide
MGIRLLCRVAFCFLAVGLV

SEQ ID NO: 187 - protein, 21 aa, Homo sapiens
  TCR 6 / TCR 12/ TCR 50/ TCR 55- Alpha Signal Peptide
MKTFAGFSFLFLWLQLDCMSR

SEQ ID NO: 188 - protein, 19 aa, Homo sapiens
  TCR 6/7/12/33/36/39/43/47/49/51/54/55/30/66 (E6)29 - Beta Signal  Peptide
MDTWLVCWAIFSLLKAGLT

SEQ ID NO: 189 - protein, 21 aa, Homo sapiens
  TCR 7/ TCR 54 - (E7)11 - Alpha Signal Peptide
MKKHLTTFLVILWLYFYRGNG

SEQ ID NO: 190 - protein, 19 aa, Homo sapiens
  TCR 8/ TCR 16 / TCR 18 - Alpha Signal Peptide
METLLGLLILWLQLQWVSS

SEQ ID NO: 191 - protein, 19 aa, Homo sapiens
  TCR 9/ TCR 26 - Beta Signal Peptide
MSLGLLCCGAFSLLWAGPV

SEQ ID NO: 192 - protein, 22 aa, Homo sapiens
  TCR 10/ TCR 28 / TCR 36 / TCR 41/TCR 66 - Alpha Signal Peptide
MMISLRVLLVILWLQLSWVWSQ

SEQ ID NO: 193 - protein, 17 aa, Homo sapiens
  TCR 11 - Alpha Signal Peptide
MKLVTSITVLLSLGIMG

SEQ ID NO: 194 - protein, 15 aa, Homo sapiens
  TCR 11 - Beta Signal Peptide
MLSLLLLLLGLGSVF

SEQ ID NO: 195 - protein, 270 aa, Homo sapiens
  TCR 11 - Alpha Native
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 196 - protein, 141 aa, Homo sapiens
  TCR 4 - (E6)29 / TCR 5 - (E6)29 / TCR 12/ TCR 55 - TCR Alpha Constant Region
NIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 197 - protein, 177 aa, Homo sapiens
  TCR 4/5/7/10/14/16/17/18/21/22/23/25/27/28/30/37/39/50 /54 - TCR beta constant region
EDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 198 - protein, 141 aa, Homo sapiens
  TCR 3/ TCR 10 TCR Alpha Constant Region
NIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 199 - protein, 179 aa, Homo sapiens
  TCR 3/ 6/8/9/11/13/19/ 20/24/29/31/32/33/34/ 35/36/38/ 40/41/42/43/ 45/46/47/48/49/51/52/55/66 - TCR beta constant region
EDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 200 - protein, 141 aa, Homo sapiens
  TCR 6/ TCR 11 Alpha Constant Region
HIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 201 - protein, 141 aa, Homo sapiens
  TCR 7/ TCR 14/ TCR 15 / TCR 20/ TCR 36/ TCR 54/TCR 66 - Alpha Constant Region
YIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 202 - DNA, 801 bp, Homo sapiens
  TCR 13 - Alpha Native
atgctcctgctgctcgtcccagtgctcgaggtgatttttactctgggaggaaccagagcccagtcggtgacccagcttgacagccacgtctctgtctctgaaggaaccccggtgctgctgaggtgcaactactcatcttcttattcaccatctctcttctggtatgtgcaacaccccaacaaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgttgtgaggggaggaaagcttatcttcggacagggaacggagttatctgtgaaacccaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgcgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 203 - protein, 141 aa, Homo sapiens; identical to SEQ ID NO: 196
  TCR 8/9/13/16/17/18/21/26/27/28/30/31/32/33/34/35/37/3 8/39/40/41/42/43/44/45/46/48/49/50/51/52/53 - alpha constant region

SEQ ID NO: 204 - protein, 22 aa, Artificial Sequence
  P2A
GSGATNFSLLKQAGDVEENPGP

SEQ ID NO: 205 - protein, 270 aa, Homo sapiens
  TCR 11 - Alpha Cysteine-modified
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 206 - protein, 312 aa, Homo sapiens
  TCR 11 - Beta Native
MLSLLLLLLGLGSVFSAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 207 - DNA, 66 bp, Artificial Sequence
  TCR 3/ TCR 6/ TCR 8/ TCR 9/ TCR 10/TCR 11/ P2A
ggatccggagctaccaacttctctctgctgaaacaggcaggcgatgtggaggaaaatcctgggcca

SEQ ID NO: 208 - DNA, 66 bp, Artificial Sequence
  TCR 4/ P2A
gggagtggagcaacaaacttttcactgctgaagcaggccggcgatgtggaggaaaatcctgggcca

SEQ ID NO: 209 - DNA, 66 bp, Artificial Sequence
  TCR 5/ P2A
gggtccggagccacaaatttttctctgctgaaacaggctggcgatgtggaggaaaaccctgggcca

SEQ ID NO: 210 - DNA, 66 bp, Artificial Sequence
  TCR 7/ P2A
ggaagcggcgcaacaaacttttccctgctgaaacaggccggagatgtggaggaaaatcctggccca

SEQ ID NO: 211 - protein, 18 aa, Artificial Sequence
  T2A
EGRGSLLTCGDVEENPGP

SEQ ID NO: 212 - protein, 141 aa, Homo sapiens
  TCR 3/ TCR 10 Native TCR Alpha onstant Region
NIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 213 - protein, 141 aa, Homo sapiens
  TCR 4/5/12/8/9/13/16/17/18 /21/26/27/28/30/31/32/33/34/35/37/38/39/40 /41/42/43/44/45/46/48/49/50/51/52/53/55 - Native TCR alpha constant region
NIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 214 - protein, 177 aa, Homo sapiens
  TCR 4/5/16/17/18/21/22/23/25/27/28/7/37/39/50/51/52/54 /10/14 - Native TCR beta constant region
EDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 215 - protein, 142 aa, Homo sapiens
  TCR 3/ TCR 10 Native TCR Alpha Constant Region
PNIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 216 - protein, 179 aa, Homo sapiens
  TCR 3/6/12/8/9/11/13/19/20/24/29/31/32/33/34/35/36/38/ 40/41/42/43/46/47/48/49/53/55/66 Native TCR beta constant region
EDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 217 - protein, 141 aa, Homo sapiens
  TCR 6/ TCR 11 Native TCR Alpha Constant Region
HIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 218 - protein, 141 aa, Homo sapiens
  TCR 7/ TCR 14/ TCR 15/ TCR 20/ TCR 36/ TCR 54/TCR 66 - Native TCR Alpha Constant Region
YIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 219 - DNA, 813 bp, Homo sapiens
  TCR 14 - Alpha Native
atggagaagaatcctttggcagccccattactaatcctctggtttcatcttgactgcgtgagcagcatactgaacgtggaacaaagtcctcagtcactgcatgttcaggagggagacagcaccaatttcacctgcagcttcccttccagcaatttttatgccttacactggtacagatgggaaactgcaaaaagccccgaggccttgtttgtaatgactttaaatggggatgaaaagaagaaaggacgaataagtgccactcttaataccaaggagggttacagctatttgtacatcaaaggatcccagcctgaagactcagccacatacctctgtgcctctcaaactggggcaaacaacctcttctttgggactggaacgagactcaccgttattccctatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 220 - protein, 142 aa, Homo sapiens
  TCR 4 - (E6)29 / TCR 5 / TCR 12 /TCR 8/ TCR 9 / TCR 13- (E6)29 - Native TCR Alpha Constant Region
PNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 221 - protein, 312 aa, Homo sapiens
  TCR 11 - Beta Cysteine-modified
MLSLLLLLLGLGSVFSAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 222 - protein, 273 aa, Homo sapiens
  TCR 12/ TCR 55 - (E7)11 - Alpha Native
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 223 - protein, 610 aa, Homo sapiens
  TCR 3 Full Sequence Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 224 - protein, 603 aa, Homo sapiens
  TCR 4 - (E6)29 Full Sequence Native
MGTSLLCWMALCLLGADHADTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 225 - protein, 610 aa, Homo sapiens
  TCR 5 - (E6)29 - TCR Full Sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 226 - protein, 607 aa, Homo sapiens
  TCR 6 Full Sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 227 - protein, 606 aa, Homo sapiens
  TCR 7/ TCR 54 - (E7)11 - Full Sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 228 - protein, 606 aa, Homo sapiens
  TCR 8 Full Sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 229 - protein, 611 aa, Homo sapiens
  TCR 9 - Full Sequence Native
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 230 - protein, 612 aa, Homo sapiens
  TCR 10 Full Sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 231 - protein, 604 aa, Homo sapiens
  TCR 11 Full Sequence Native
MLSLLLLLLGLGSVFSAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 232 - protein, 9 aa, Human papillomavirus
  E6(18-26) Peptide
KLPQLCTEL

SEQ ID NO: 233 - protein, 10 aa, Human papillomavirus
  E6(29-38) Peptide
TIHDIILECV

SEQ ID NO: 234 - protein, 9 aa, Human papillomavirus
  E6(52-60) Peptide
FAFRDLCIV

SEQ ID NO: 235 - protein, 8 aa, Human papillomavirus
  E7(86-93) Peptide
TLGIVCPI

SEQ ID NO: 236 - protein, 9 aa, Human papillomavirus
  E7(11-19) Peptide
YMLDLQPET

SEQ ID NO: 237 - protein, 9 aa, Human papillomavirus
  E7(85-93) Peptide
GTLGIVCPI

SEQ ID NO: 238 - protein, 9 aa, Human papillomavirus
  E7(82-90) Peptide
LLMGTLGIV

SEQ ID NO: 239 - protein, 9 aa, Human papillomavirus
  E7(7-15) Peptide
TLHEYMLDL

SEQ ID NO: 240 - protein, 7 aa, Artificial Sequence
  TCR Alpha E6(29-38) CDR1 Consensus
  VARIANT (1)...(1): X1 = T, D, S, or N
  VARIANT (2)...(2): X2 = I, or S
  VARIANT (3)...(3): X3 = S, D, N, Y, or A
  VARIANT (4)...(4): X4 = G, Q, P, or null
  VARIANT (5)...(5): X5 = T, S, F, or I
  VARIANT (6)...(6): X6 = D, Y, P, or Q
  VARIANT (7)...(7): X7 = Y, G, N, A, S, or Q
XXXXXXX

SEQ ID NO: 241 - protein, 6 aa, Artificial Sequence
  TCR Alpha E7(11-19) CDR1 Consensus
  VARIANT (1)...(1): X1 = D or V
  VARIANT (3)...(3): X3 = S, or P
  VARIANT (4)...(4): X4 = S or F
  VARIANT (5)...(5): X5 = T or S
  VARIANT (6)...(6): X6 = Y or N
XSXXXX

SEQ ID NO: 242 - protein, 273 aa, Homo sapiens
  TCR 12 / TCR 55 - (E7)11  - Alpha Cysteine-modified
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 243 - protein, 7 aa, Artificial Sequence
  TCR Alpha Overall CDR1 Consensus
  VARIANT (1)...(1): X1 = T, D, N, S, or V
  VARIANT (2)...(2): X2 = I or S
  VARIANT (3)...(3): X3 = S, D, A, P, N, or Y
  VARIANT (4)...(4): X4 = G, Q, P, or null
  VARIANT (5)...(5): X5 = T, S, I, or F
  VARIANT (6)...(6): X6 = D, Y, ,Q, T, P, or S
  VARIANT (7)...(7): X7 = Y, G, N, A, S, or Q
XXXXXXX

SEQ ID NO: 244 - protein, 8 aa, Artificial Sequence
  TCR Alpha E6(29-38) CDR2 Consensus
  VARIANT (1)...(1): X1 = G, Q, I, M, Y, or V
  VARIANT (2)...(2): X2 = L, S, Q, T, or Y
  VARIANT (3)...(3): X3 = T, G, L, or S
  VARIANT (4)...(4): X4 = Y, S, N, A, or null
  VARIANT (5)...(5): X5 = null, A, or D
  VARIANT (6)...(6): X6 = null, E, Q, T, or S
  VARIANT (7)...(7): X7 = S, Q, R, L, or G
  VARIANT (8)...(8): X8 = N, V, or E
XXXXXXXX

SEQ ID NO: 245 - protein, 7 aa, Artificial Sequence
  TCR Alpha E7(11-19) CDR2 Consensus
  VARIANT (1)...(1): X1 = I or M
  VARIANT (2)...(2): X2 = F or T
  VARIANT (3)...(3): X3 = S or F
  VARIANT (4)...(4): X4 = N or S
  VARIANT (5)...(5): X5 = M or E
  VARIANT (6)...(6): X6 = D or N
  VARIANT (7)...(7): X7 = M or T
XXXXXXX

SEQ ID NO: 246 - protein, 311 aa, Homo sapiens
  TCR 6, TCR 12, TCR 55 - (E7)11 -Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 247 - protein, 8 aa, Artificial Sequence
  TCR Alpha Overall CDR2 Consensus
  VARIANT (1)...(1): X1 = G, Q, I, V, Y, or M
  VARIANT (2)...(2): X2 = L, S, Q, Y, F, or T
  VARIANT (3)...(3): X3 = T, G, S, L, or F
  VARIANT (4)...(4): X4 = Y, S, N, A, or null
  VARIANT (5)...(5): X5 = null, A, or D
  VARIANT (6)...(6): X6 = null, E, Q, S, M, or T
  VARIANT (7)...(7): X7 = S, Q, R, G, D, L, or N
  VARIANT (8)...(8): X8 = N, E, M, T, or V
XXXXXXXX

SEQ ID NO: 248 - protein, 18 aa, Artificial Sequence
  TCR Alpha E6(29-38) CDR3 Consensus
  VARIANT (1)...(1): X1 = A, I, or V
  VARIANT (2)...(2): X2 = M, L, S, or V
  VARIANT (3)...(3): X3 = R, L, Q, or N
  VARIANT (4)...(4): X4 = E, V, T, P, G, or F
  VARIANT (5)...(5): X5 = G, I, L, A, null, or P
  VARIANT (6)...(6): X6 = R, T, G, null, or S
  VARIANT (7)...(7): X7 = G, R, or null
  VARIANT (8)...(8): X8 = T, G, or null
  VARIANT (9)...(9): X9 = null or A
  VARIANT (10)...(10): X10 = null or G
  VARIANT (11)...(11): X11 = null or G
  VARIANT (12)...(12): X12 = null or T
  VARIANT (13)...(13): X13 = null or S
  VARIANT (14)...(14): X14 = G, Y, null, or N
  VARIANT (15)...(15): X15 = F, G, N, or T
  VARIANT (16)...(16): X16 = K or N, P
  VARIANT (17)...(18): X17 = T or L X18 = I, V, F or T
XXXXXXXXXXXXXXXXXX

SEQ ID NO: 249 - protein, 11 aa, Artificial Sequence
  TCR Alpha E7(11-19) CDR3 Consensus
  VARIANT (1)...(1): X1 = A or V
  VARIANT (2)...(3): X2 = E or V
  VARIANT (3)...(3): X3 = S or P
  VARIANT (4)...(4): X4 = I, S, or R
  VARIANT (5)...(5): X5 = R, G, or D
  VARIANT (6)...(6): X6 = G, A, or N
  VARIANT (7)...(7): X7 = F, null, or Y
  VARIANT (8)...(8): X8 = G or T
  VARIANT (9)...(9): X9 = N, T, or Q
  VARIANT (10)...(10): X10 = V, K or N
  VARIANT (11)...(11): X11 = L or F
  VARIANT (12)...(12): X12 = H, I, or V
XXXXXXXXXXX

SEQ ID NO: 250 - protein, 311 aa, Homo sapiens
  TCR 6, TCR 12, TCR 55 - (E7)11  - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 251 - protein, 18 aa, Artificial Sequence
  TCR Alpha Overall CDR3 Consensus
  VARIANT (1)...(1): X1 = A, I, or V
  VARIANT (2)...(2): X2 = M, L, V, E, or S
  VARIANT (3)...(3): X3 = R, L, N, Q, P, or S
  VARIANT (4)...(4): X4 = E, V, P, T, F, I, R, G, S, or A
  VARIANT (5)...(5): X5 = G, I, L, A, P, R, D, null, or H
  VARIANT (6)...(6): X6 = R, T, G, S, N, null, or A
  VARIANT (7)...(7): X7 = G, R, N, or null
  VARIANT (8)...(8): X8 = T, G, or null
  VARIANT (9)...(9): X9 = null, or A
  VARIANT (10)...(10): X10 = null or G
  VARIANT (11)...(11): X11 = null or G
  VARIANT (12)...(12): X12 = null or T
  VARIANT (13)...(13): X13 = F, Y, S or null
  VARIANT (14)...(14): X14 = G, Y, null, or N
  VARIANT (15)...(15): X15 = F, G, T, N, Q, or Y
  VARIANT (16)...(16): X16 = K, P, V, N or A
  VARIANT (17)...(18): X17 = T, L, or F X18 = I, V, T, H, F, or N
XXXXXXXXXXXXXXXXXX

SEQ ID NO: 252 - protein, 5 aa, Artificial Sequence
  TCR Beta E6(29-38) CDR1 Consensus
  VARIANT (1)...(1): X1 = S or M
  VARIANT (2)...(2): X2 = G, E, D, or N
  VARIANT (4)...(4): X4 = V, N, or E
  VARIANT (5)...(5): X5 = S, R, N, or Y
XXHXX

SEQ ID NO: 253 - protein, 270 aa, Homo sapiens
  TCR 13 - Alpha Native
MLLLLVPVLEVIFTLGGTRAQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 254 - protein, 5 aa, Artificial Sequence
  TCR beta Overall CDR1 Consensus
  VARIANT (1)...(1): X1 = S or M
  VARIANT (2)...(2): X2 = G, E, D, N, or Q
  VARIANT (3)...(3): X3 = H or V
  VARIANT (4)...(4): X4 = V, N, E, L, or T
  VARIANT (5)...(5): X5 = S, R, N, Y, or M
XXXXX

SEQ ID NO: 255 - protein, 6 aa, Artificial Sequence
  TCR Beta E6(29-38) CDR2 Consensus
  VARIANT (1)...(1): X1 = F or S
  VARIANT (2)...(2): X2 = Q, Y, or V
  VARIANT (3)...(3): X3 = N, D, or G
  VARIANT (4)...(4): X4 = E or V
  VARIANT (5)...(5): X5 = A, K, or G
  VARIANT (6)...(6): X6 = Q, M, or T
XXXXXX

SEQ ID NO: 256 - protein, 270 aa, Homo sapiens
  TCR 13 - Alpha Cysteine-modified
MLLLLVPVLEVIFTLGGTRAQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 257 - protein, 7 aa, Artificial Sequence
  TCR Beta Overall CDR2 Consensus
  VARIANT (1)...(1): X1 = F, S, or A
  VARIANT (2)...(2): X2 = Q, Y, V, or N
  VARIANT (3)...(3): X3 = N, D, G, or Q
  VARIANT (5)...(5): X5 = E, V, N, or S
  VARIANT (6)...(6): X6 = A, K, G, or E
  VARIANT (7)...(7): X7 = Q, M, T, I, or A
XXXGXXX

SEQ ID NO: 258 - protein, 13 aa, Artificial Sequence
  TCR Beta E6(29-38) CDR3 Consensus
  VARIANT (3)...(3): X3 = S or T
  VARIANT (4)...(4): X4 = H, P, L, F, or Y
  VARIANT (5)...(5): X5 = L, G, W, F, T, or S
  VARIANT (6)...(6): X6 = A, G, or L
  VARIANT (7)...(7): X7 = G, E, A, T, Q, or null
  VARIANT (8)...(8): X8 = F, G, T, R, or S
  VARIANT (9)...(9): X9 = T, N, H, R, E, or A
  VARIANT (10)...(10): X10 = G, T, Q, D, R, or Y
  VARIANT (11)...(11): X11 = E, P, T, or G
  VARIANT (12)...(12): X12 = L, A, Q, or Y
  VARIANT (13)...(13): X13 = F, H, Y, or T
ASXXXXXXXXXXX

SEQ ID NO: 259 - protein, 11 aa, Artificial Sequence
  TCR Beta E7(11-19) CDR3 Consensus
  VARIANT (2)...(2): X2 = S or I
  VARIANT (4)...(4): X4 = T or D
  VARIANT (6)...(6): X6 = S or T
  VARIANT (7)...(7): X7 = S or N
  VARIANT (9)...(9): X9 = E or G
  VARIANT (10)...(10): X10 = Q or Y
  VARIANT (11)...(11): X11 = Y or T
AXTXRXXYXXX

SEQ ID NO: 260 - protein, 312 aa, Homo sapiens
  TCR 13 - Beta Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 261 - protein, 15 aa, Artificial Sequence
  TCR Beta Overall CDR3 Consensus
  VARIANT (1)...(1): X1 = A or S
  VARIANT (2)...(2): X2 = S, I, or V
  VARIANT (3)...(3): X3 = S, T, or V
  VARIANT (4)...(4): X4 = H, P, L, Y, T, D, or F
  VARIANT (5)...(5): X5 = L, G, W, F, S, T, or R
  VARIANT (6)...(6): X6 = A, G, L, S, or T
  VARIANT (7)...(7): X7 = G, E, A, T, R, Q, or null
  VARIANT (8)...(8): X8 = null or G
  VARIANT (9)...(9): X9 = null or G
  VARIANT (10)...(10): X10 = null, F, G, T, S, or R
  VARIANT (11)...(11): X11 = T, N, H, A, S, R, or E
  VARIANT (12)...(12): X12 = G, T, Q, D, Y, or R
  VARIANT (13)...(13): X13 = E, P, T, or G
  VARIANT (14)...(14): X14 = L, A, Q, or Y
  VARIANT (15)...(15): X15 = F, H, Y, or T
XXXXXXXXXXXXXXX

SEQ ID NO: 262 - protein, 137 aa, Mus musculus
  Mouse Alpha Constant
DIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSS

SEQ ID NO: 263 - protein, 173 aa, Mus musculus
  Mouse Beta Constant
EDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 264 - protein, 158 aa, Human papillomavirus
  HPV 16 E6
MHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQL

SEQ ID NO: 265 - protein, 98 aa, Human papillomavirus
  HPV 16 E7
MHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 266 - protein, 10 aa, Artificial Sequence
  Linker
  REPEAT (5)...(9): Occurring 5 or 6 times
PGGGSGGGGP

SEQ ID NO: 267 - protein, 17 aa, Artificial Sequence
  Linker
GSADDAKKDAAKKDGKS

SEQ ID NO: 268 - protein, 12 aa, Homo sapiens
  Spacer (IgG4hinge)
ESKYGPPCPPCP

SEQ ID NO: 269 - DNA, 36 bp, Homo sapiens
  Spacer (IgG4hinge)
gaatctaagtacggaccgccctgccccccttgccct

SEQ ID NO: 270 - protein, 119 aa, Homo sapiens
  Hinge-CH3 Spacer
ESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 271 - protein, 229 aa, Homo sapiens
  Hinge-CH2-CH3 Spacer
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 272 - protein, 282 aa, Homo sapiens
  IgD-hinge-Fc
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 273 - protein, 357 aa, Artificial Sequence
  tEGFR
MLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 274 - protein, 24 aa, Artificial Sequence
  T2A
LEGGGEGRGSLLTCGDVEENPGPR

SEQ ID NO: 275 - protein, 27 aa, Homo sapiens
  CD28 (amino acids 153-179 of Accession No. P10747)
FWVLVVVGGVLACYSLLVTVAFIIFWV

SEQ ID NO: 276 - protein, 66 aa, Homo sapiens
  CD28 (amino acids 114-179 of Accession No. P10747)
IEVMYPPPYLDNEKSNGTIIHVKGKHLCPSPLFPGPSKPFWVLVVVGGVLACYSLLVTVAFIIFWV

SEQ ID NO: 277 - protein, 41 aa, Homo sapiens
  CD28 (amino acids 180-220 of P10747)
RSKRSRLLHSDYMNMTPRRPGPTRKHYQPYAPPRDFAAYRS

SEQ ID NO: 278 - protein, 41 aa, Homo sapiens
  CD28 (LL to GG)
RSKRSRGGHSDYMNMTPRRPGPTRKHYQPYAPPRDFAAYRS

SEQ ID NO: 279 - protein, 42 aa, Homo sapiens
  4-1BB (amino acids 214-255 of Q07011.1)
KRGRKKLLYIFKQPFMRPVQTTQEEDGCSCRFPEEEEGGCEL

SEQ ID NO: 280 - protein, 112 aa, Homo sapiens
  CD3 zeta
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 281 - protein, 112 aa, Homo sapiens
  CD3 zeta
RVKFSRSAEPPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 282 - protein, 112 aa, Homo sapiens
  CD3 zeta
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 283 - protein, 252 aa, Homo sapiens
  TCR 12 / TCR 55 - (E7)11 - Alpha  Native
GEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 284 - protein, 252 aa, Homo sapiens
  TCR 12 / TCR 55- (E7)11 - Alpha Cysteine-modified
GEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 285 - protein, 292 aa, Homo sapiens; identical to SEQ ID NO: 52
  TCR 6, TCR 12, TCR 55 - (E7)11 - Beta Native

SEQ ID NO: 286 - protein, 292 aa, Homo sapiens; identical to SEQ ID NO: 53
  TCR 6, TCR 12, TCR 55  - (E7)11 - Beta Cysteine-modified

SEQ ID NO: 287 - protein, 251 aa, Homo sapiens
  TCR 13 - Alpha Native
AQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 288 - protein, 251 aa, Homo sapiens
  TCR 13 - Alpha  Cysteine-modified
AQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 289 - protein, 293 aa, Homo sapiens
  TCR 13 - Beta Native
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 290 - protein, 293 aa, Homo sapiens
  TCR 13 -Beta Cysteine-modified
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 291 - protein, 252 aa, Homo sapiens
  TCR 14 -Alpha Native
ILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 292 - protein, 252 aa, Homo sapiens
  TCR 14 -Alpha  Cysteine-modified
ILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 293 - protein, 291 aa, Homo sapiens
  TCR 14 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 294 - protein, 291 aa, Homo sapiens
  TCR 14 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 295 - protein, 111 aa, Homo sapiens
  TCR 12/ TCR 55 -  Alpha Variable
GEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQP

SEQ ID NO: 296 - protein, 113 aa, Homo sapiens; identical to SEQ ID NO: 118
  TCR 6, TCR 12, TCR 55  -  Beta Variable

SEQ ID NO: 297 - protein, 110 aa, Homo sapiens
  TCR 13 -  Alpha Variable
AQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKP

SEQ ID NO: 298 - protein, 114 aa, Homo sapiens
  TCR 13 -  Beta Variable
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVL

SEQ ID NO: 299 - protein, 111 aa, Homo sapiens
  TCR 14 -  Alpha Variable
ILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIP

SEQ ID NO: 300 - protein, 114 aa, Homo sapiens
  TCR 14 -  Beta Variable
DVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVV

SEQ ID NO: 301 - protein, 11 aa, Homo sapiens
  TCR 12/ TCR 55 CDR3 Alpha
AVPSGATNKLI

SEQ ID NO: 302 - protein, 6 aa, Homo sapiens
  TCR 13 CDR1 Alpha
SSYSPS

SEQ ID NO: 303 - protein, 8 aa, Homo sapiens
  TCR 13 CDR2 Alpha
YTSAATLV

SEQ ID NO: 304 - protein, 8 aa, Homo sapiens
  TCR 13 CDR3 Alpha
VVRGGKLI

SEQ ID NO: 305 - protein, 12 aa, Homo sapiens
  TCR 13 CDR3 Beta
ASSPTGTERELF

SEQ ID NO: 306 - protein, 6 aa, Homo sapiens
  TCR 14 CDR1 Alpha
SSNFYA

SEQ ID NO: 307 - protein, 7 aa, Homo sapiens
  TCR 14 CDR2 Alpha
MTLNGDE

SEQ ID NO: 308 - protein, 10 aa, Homo sapiens
  TCR 14 CDR3 Alpha
ASQTGANNLF

SEQ ID NO: 309 - protein, 13 aa, Homo sapiens
  TCR 14 CDR3 Beta
ASTFWGQRRTEAF

SEQ ID NO: 310 - protein, 19 aa, Homo sapiens
  TCR 13 Alpha Signal Sequence
MLLLLVPVLEVIFTLGGTR

SEQ ID NO: 311 - protein, 22 aa, Homo sapiens
  TCR 14 Alpha Signal Sequence
MEKNPLAAPLLILWFHLDCVSS

SEQ ID NO: 312 - protein, 312 aa, Homo sapiens
  TCR 13 - Beta Cysteine-modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 313 - protein, 274 aa, Homo sapiens
  TCR 14 - Alpha Native
MEKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 314 - protein, 274 aa, Homo sapiens
  TCR 14 - Alpha Cysteine-modified
MEKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 315 - protein, 310 aa, Homo sapiens
  TCR 14 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 316 - protein, 310 aa, Homo sapiens
  TCR 14 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 317 - protein, 137 aa, Mus musculus
  Mouse Alpha Constant Sequence
NIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSS

SEQ ID NO: 318 - protein, 275 aa, Homo sapiens
  TCR 3 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 319 - protein, 275 aa, Homo sapiens
  TCR 3 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 320 - protein, 313 aa, Homo sapiens
  TCR 3 - Beta Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 321 - protein, 313 aa, Homo sapiens
  TCR 3 - Beta Cysteine-modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 322 - protein, 271 aa, Homo sapiens
  TCR 4 - (E6)29 Alpha Native
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 323 - protein, 271 aa, Homo sapiens
  TCR 4 - (E6)29 Alpha Cysteine-modified
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 324 - protein, 310 aa, Homo sapiens
  TCR 4 - (E6)29 Beta Native
MGTSLLCWMALCLLGADHADTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 325 - protein, 310 aa, Homo sapiens
  TCR 4 - (E6)29 Beta Cysteine-modified
MGTSLLCWMALCLLGADHADTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 326 - protein, 278 aa, Homo sapiens
  TCR 5 - (E6)29 - TCR Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 327 - protein, 278 aa, Homo sapiens
  TCR 5 - (E6)29 - TCR Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 328 - protein, 310 aa, Homo sapiens
  TCR 5 - (E6)29 - TCR Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 329 - protein, 310 aa, Homo sapiens
  TCR 5 - (E6)29 - TCR Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 330 - protein, 274 aa, Homo sapiens
  TCR 6 - Alpha Native
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 331 - protein, 274 aa, Homo sapiens
  TCR 6 - Alpha Cysteine-modified
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 332 - protein, 311 aa, Homo sapiens; identical to SEQ ID NO: 246
  TCR 6, TCR 12 - Beta Native

SEQ ID NO: 333 - protein, 311 aa, Homo sapiens; identical to SEQ ID NO: 250
  TCR 6, TCR 12 - Beta Cysteine-modified

SEQ ID NO: 334 - protein, 275 aa, Homo sapiens
  TCR 7/ TCR 54 - (E7)11 - Alpha Native
MKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 335 - protein, 275 aa, Homo sapiens
  TCR 7/ TCR 54 - (E7)11 - Alpha Cysteine-modified
MKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 336 - protein, 309 aa, Homo sapiens
  TCR 7/ TCR 54 -(E7)11 -Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 337 - protein, 309 aa, Homo sapiens
  TCR 7/ TCR 54 - (E7)11 -Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 338 - protein, 272 aa, Homo sapiens
  TCR 8 - Alpha Native
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 339 - protein, 272 aa, Homo sapiens
  TCR 8 - Alpha Cysteine-modified
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 340 - protein, 606 aa, Homo sapiens
  TCR 12/ TCR 55 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 341 - protein, 604 aa, Homo sapiens
  TCR 13 Full sequence Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLLLVPVLEVIFTLGGTRAQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 342 - protein, 606 aa, Homo sapiens
  TCR 14 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMEKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 343 - protein, 335 aa, Artificial Sequence
  tEGFR
RKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 344 - protein, 22 aa, Artificial Sequence
  F2A
VKQTLNFDLLKLAGDVESNPGP

SEQ ID NO: 345 - protein, 19 aa, Artificial Sequence
  P2A
ATNFSLLKQAGDVEENPGP

SEQ ID NO: 346 - protein, 20 aa, Artificial Sequence
  E2A
QCTNYALLKLAGDVESNPGP

SEQ ID NO: 347 - DNA, 66 bp, Artificial Sequence
  TCR 49/ TCR 51/ TCR 52 / TCR 53 / TCR 55 - P2A
ggaagcggcgccacaaacttctcactgctgaaacaggccggcgacgtggaggagaatcctggccca

SEQ ID NO: 348 - DNA, 4627 bp, Homo sapiens
  Human TCR alpha constant (TRAC)
  ref <308>: DATABASE ACCESSION NUMBER: NCBI NG_001332.3
  ref <309>: DATABASE ENTRY DATE: 2016-08-31
atatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacagggccttctaggccatgagagggtagacagtattctaaggacgccagaaagctgttgatcggcttcaagcaggggagggacacctaatttgcttttcttttttttttttttttttttttttttttttgagatggagttttgctcttgttgcccaggctggagtgcaatggtgcatcttggctcactgcaacctccgcctcccaggttcaagtgattctcctgcctcagcctcccgagtagctgagattacaggcacccgccaccatgcctggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccatctctgactttccattctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggtagcggaactcactaaggggcccatctggacccgaggtattgtgatgataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctgaggtgaggggccttgaagctgggagtggggtttagggacgcgggtctctgggtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgcacttctcccctatgaggtaggaagaacagttgtttagaaacgaagaaactgaggccccacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcaccctcctcccccagggtccccagtcgtcttgctgacaactgcatcctgttccatcaccatcaaaaaaaaactccaggctgggtgcgggggctcacacctgtaatcccagcactttgggaggcagaggcaggaggagcacaggagctggagaccagcctgggcaacacagggagaccccgcctctacaaaaagtgaaaaaattaaccaggtgtggtgctgcacacctgtagtcccagctacttaagaggctgagatgggaggatcgcttgagccctggaatgttgaggctacaatgagctgtgattgcgtcactgcactccagcctggaagacaaagcaagatcctgtctcaaataataaaaaaaataagaactccagggtacatttgctcctagaactctaccacatagccccaaacagagccatcaccatcacatccctaacagtcctgggtcttcctcagtgtccagcctgacttctgttcttcctcattccagatctgcaagattgtaagacagcctgtgctccctcgctccttcctctgcattgcccctcttctccctctccaaacagagggaactctcctacccccaaggaggtgaaagctgctaccacctctgtgcccccccggcaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctgcagaatgttgtgaggggtttatttttttttaatagtgttcataaagaaatacatagtattcttcttctcaagacgtggggggaaattatctcattatcgaggccctgctatgctgtgtatctgggcgtgttgtatgtcctgctgccgatgccttc

SEQ ID NO: 349 - DNA, 1448 bp, Homo sapiens
  Human TCR beta constant 1 (TRBC1)
  ref <308>: DATABASE ACCESSION NUMBER: NCBI NG_001333.2
  ref <309>: DATABASE ENTRY DATE: 2016-08-31
aggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctga

SEQ ID NO: 350 - protein, 610 aa, Homo sapiens
  TCR 15 Full sequence Cysteine-modified
MDSWTFCCVSLCILVAKHTDAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 351 - protein, 604 aa, Homo sapiens
  TCR 16 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 352 - protein, 607 aa, Homo sapiens
  TCR 17 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 353 - protein, 607 aa, Homo sapiens
  TCR 18 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 354 - protein, 611 aa, Homo sapiens
  TCR 19 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 355 - protein, 608 aa, Homo sapiens
  TCR 20 Full sequence Cysteine-modified
MLLLLLLLGPGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 356 - protein, 625 aa, Homo sapiens
  TCR 21 Full sequence Cysteine-modified
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 357 - protein, 617 aa, Homo sapiens
  TCR 22 Full sequence Cysteine-modified
MGPGLLCWVLLCLLGAGPVDAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 358 - protein, 609 aa, Homo sapiens
  TCR 23 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 359 - protein, 612 aa, Homo sapiens
  TCR 24 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 360 - protein, 611 aa, Homo sapiens
  TCR 25 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 361 - protein, 610 aa, Homo sapiens
  TCR 26 Full sequence Cysteine-modified
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 362 - protein, 618 aa, Homo sapiens
  TCR 27 Full sequence Cysteine-modified
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 363 - protein, 608 aa, Homo sapiens
  TCR 28 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 364 - protein, 611 aa, Homo sapiens
  TCR 29 Full sequence Cysteine-modified
MSNQVLCCVVLCLLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 365 - protein, 605 aa, Homo sapiens
  TCR 30 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMRLVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 366 - protein, 614 aa, Homo sapiens
  TCR 31 Full sequence Cysteine-modified
MGTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 367 - protein, 602 aa, Homo sapiens
  TCR 32 Full sequence Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 368 - protein, 609 aa, Homo sapiens
  TCR 33 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 369 - protein, 601 aa, Homo sapiens
  TCR 34 Full sequence Cysteine-modified
MGPGLLCWALLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 370 - protein, 605 aa, Homo sapiens
  TCR 35 Full sequence Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 371 - protein, 607 aa, Homo sapiens
  TCR 36 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 372 - protein, 603 aa, Homo sapiens
  TCR 37 Full sequence Cysteine-modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 373 - protein, 612 aa, Homo sapiens
  TCR 38 Full sequence Cysteine-modified
MGPGLLCWVLLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVKMPGARRQSIMKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 374 - protein, 592 aa, Homo sapiens
  TCR 39 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMQLTWVSGQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 375 - protein, 638 aa, Homo sapiens
  TCR 40 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 376 - protein, 610 aa, Homo sapiens
  TCR 41 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 377 - protein, 638 aa, Homo sapiens
  TCR 42 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 378 - protein, 609 aa, Homo sapiens
  TCR 43 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 379 - protein, 616 aa, Homo sapiens
  TCR 44 Full sequence Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 380 - protein, 642 aa, Homo sapiens
  TCR 45 Full sequence Cysteine-modified
MGTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 381 - protein, 609 aa, Homo sapiens
  TCR 46 Full sequence Cysteine-modified
MGTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLLLVPAFQVIFTLGGTRAQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 382 - protein, 609 aa, Homo sapiens
  TCR 47 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 383 - protein, 607 aa, Homo sapiens
  TCR 48 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 384 - protein, 609 aa, Homo sapiens
  TCR 49 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 385 - protein, 604 aa, Homo sapiens
  TCR 50 Full sequence Cysteine-modified
MGFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 386 - protein, 610 aa, Homo sapiens
  TCR 51 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 387 - protein, 601 aa, Homo sapiens
  TCR 52 Full sequence Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 388 - protein, 611 aa, Homo sapiens
  TCR 53 Full sequence Cysteine-modified
MGTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 389 - DNA, 495 bp, Homo sapiens
  TCR 15 - Alpha Native
gaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgaagcctggtggctacaataagctgatttttggagcagggaccaggctggctgtacaccca

SEQ ID NO: 390 - DNA, 455 bp, Homo sapiens
  TCR 15 - Beta Native
gatgctcacagagggcctggtctagaatattccacatctgctctcactctgccatggactcctggaccttctgctgtgtgtccctttgcatcctggtagcgaagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttggtcggcaggagtcggaccgagcagtacttcgggccgggcaccaggctcacggtcaca

SEQ ID NO: 391 - protein, 610 aa, Homo sapiens
  TCR 15 Full sequence Native
MDSWTFCCVSLCILVAKHTDAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 392 - protein, 604 aa, Homo sapiens
  TCR 16 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 393 - protein, 607 aa, Homo sapiens
  TCR 17 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 394 - protein, 607 aa, Homo sapiens
  TCR 18 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 395 - protein, 611 aa, Homo sapiens
  TCR 19 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 396 - protein, 608 aa, Homo sapiens
  TCR 20 Full sequence Native
MLLLLLLLGPGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 397 - protein, 625 aa, Homo sapiens
  TCR 21 Full sequence Native
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 398 - protein, 617 aa, Homo sapiens
  TCR 22 Full sequence Native
MGPGLLCWVLLCLLGAGPVDAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 399 - protein, 609 aa, Homo sapiens
  TCR 23 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 400 - protein, 612 aa, Homo sapiens
  TCR 24 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 401 - protein, 611 aa, Homo sapiens
  TCR 25 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVELNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 402 - protein, 610 aa, Homo sapiens
  TCR 26 Full sequence Native
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 403 - protein, 618 aa, Homo sapiens
  TCR 27 Full sequence Native
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 404 - protein, 608 aa, Homo sapiens
  TCR 28 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 405 - protein, 611 aa, Homo sapiens
  TCR 29 Full sequence Native
MSNQVLCCVVLCLLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 406 - protein, 605 aa, Homo sapiens
  TCR 30 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMRLVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 407 - protein, 614 aa, Homo sapiens
  TCR 31 Full sequence Native
MGTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 408 - protein, 602 aa, Homo sapiens
  TCR 32 Full sequence Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 409 - protein, 609 aa, Homo sapiens
  TCR 33 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 410 - protein, 601 aa, Homo sapiens
  TCR 34 Full sequence Native
MGPGLLCWALLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 411 - protein, 605 aa, Homo sapiens
  TCR 35 Full sequence Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 412 - protein, 607 aa, Homo sapiens
  TCR 36 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 413 - protein, 603 aa, Homo sapiens
  TCR 37 Full sequence Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 414 - protein, 612 aa, Homo sapiens
  TCR 38 Full sequence Native
MGPGLLCWVLLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVKMPGARRQSIMKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 415 - protein, 592 aa, Homo sapiens
  TCR 39 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMQLTWVSGQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 416 - protein, 638 aa, Homo sapiens
  TCR 40 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 417 - protein, 610 aa, Homo sapiens
  TCR 41 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 418 - protein, 638 aa, Homo sapiens
  TCR 42 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 419 - protein, 609 aa, Homo sapiens
  TCR 43 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 420 - protein, 616 aa, Homo sapiens
  TCR 44 Full sequence Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 421 - protein, 642 aa, Homo sapiens
  TCR 45 Full sequence Native
MGTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 422 - protein, 609 aa, Homo sapiens
  TCR 46 Full sequence Native
MGTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLLLVPAFQVIFTLGGTRAQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 423 - protein, 609 aa, Homo sapiens
  TCR 47 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 424 - protein, 607 aa, Homo sapiens
  TCR 48 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 425 - protein, 609 aa, Homo sapiens
  TCR 49 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 426 - protein, 604 aa, Homo sapiens
  TCR 50 Full sequence Native
MGFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 427 - protein, 610 aa, Homo sapiens
  TCR 51 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 428 - protein, 601 aa, Homo sapiens
  TCR 52 Full sequence Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 429 - protein, 611 aa, Homo sapiens
  TCR 53 Full sequence Native
MGTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 430 - DNA, 472 bp, Homo sapiens
  TCR 16 - Alpha Native
agagtgtttatcttgtgagccattctccatatttcagatataagatttcagttctcagtgagtctaagtgacagaaggaatggagaccctcttgggcctgcttatcctttggctgcagctgcaatgggtgagcagcaaacaggaggtgacgcagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgaggcccgccaataacaatgacatgcgctttggagcagggaccagactgacagtaaaacca

SEQ ID NO: 431 - DNA, 420 bp, Homo sapiens
  TCR 16 - Beta Native
gattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgggggcgcagcaatcagccccagcattttggtgatgggactcgactctccatccta

SEQ ID NO: 432 - DNA, 1833 bp, Homo sapiens
  TCR 15 Codon-optimized / cysteine-modified full sequence
atggacagctggaccttttgctgcgtgtccctgtgcatcctggtggccaagcacaccgatgccggcgtgatccagagccccagacacgaagtgaccgagatgggccaggaagtgaccctgcgctgcaagcccatcagcggccacaacagcctgttctggtacagacagaccatgatgcggggcctggaactgctgatctacttcaacaacaacgtgcccatcgacgacagcggcatgcccgaggacagattcagcgccaagatgcccaacgccagcttcagcaccctgaagatccagcccagcgagcccagagacagcgccgtgtacttttgcgccagcagcctcgtgggcagaagccggaccgagcagtactttggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgaagcctggcggctacaacaagctgatcttcggagccggcaccagactggccgtgcacccttatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 433 - DNA, 1815 bp, Homo sapiens
  TCR 16 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggcagaagcaaccagcctcagcacttcggcgacggcaccagactgagcatcctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatggaaaccctgctgggcctgctgatcctgtggctgcagctccagtgggtgtccagcaagcaggaagtgacccagatccctgccgccctgtctgtgcctgagggcgagaacctggtgctgaactgcagcttcaccgacagcgccatctacaacctgcagtggttccggcaggaccccggcaagggactgacaagcctgctgctgattcagagcagccagagagagcagaccagcggcagactgaacgccagcctggacaagtcctccggcagaagcaccctgtatatcgccgcctcccagcctggcgatagcgccacatatctgtgtgccgtgcggcctgccaacaacaacgacatgagattcggagccggcacccggctgaccgtgaagcctaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 434 - DNA, 1824 bp, Homo sapiens
  TCR 17 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggcagaagcaaccagcctcagcacttcggcgacggcaccagactgagcatcctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccccagctacggcctgttctggtacaagcagcccagcagcggcgagatgatcttcctgatctaccagggcagctacgaccagcagaacgccaccgagggccggtacagcctgaacttccagaaggcccggaagtccgccaacctggtcatctctgccagccagctgggcgacagcgccatgtacttttgcgccatgagagagggcagaggcgacaagatcattttcggcaagggcacccggctgcacatcctgcccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 435 - DNA, 1824 bp, Homo sapiens
  TCR 18 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcttctggggcagaagcaacagccctctgcacttcggcaacggcaccagactgaccgtgaccgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatggaaaccctgctgggcctgctgatcctgtggctgcagctccagtgggtgtccagcaagcaggaagtgacccagatccctgccgccctgtctgtgcctgagggcgagaacctggtgctgaactgcagcttcaccgacagcgccatctacaacctgcagtggttccggcaggaccccggcaagggactgacaagcctgctgctgattcagagcagccagagagagcagaccagcggcagactgaacgccagcctggacaagtcctccggcagaagcaccctgtatatcgccgcctcccagcctggcgatagcgccacatatctgtgcgccgagggcaatgccggcggaaccagctacggcaagctgacctttggccagggcaccatcctgaccgtgcaccccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 436 - DNA, 1836 bp, Homo sapiens
  TCR 19 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcagctggggccagagcacaggcgagcagtactttggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagaacaccggcaccgccagcaagctgaccttcggcacaggcaccagactgcaggtcacactggacatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 437 - DNA, 1827 bp, Homo sapiens
  TCR 20 Codon-optimized / cysteine-modified full sequence
atgctgctgctcctgctcctcctgggacctggatctggactgggagccgtggtgtcccagcaccccagcagagtgatctgcaagagcggcaccagcgtgaagatcgagtgcagaagcctggacttccaggccaccaccatgttctggtacagacagttccccaagcagagcctgatgctgatggccacctccaacgagggcagcaaggccacatacgagcagggcgtggaaaaggacaagttcctgatcaaccacgccagcctgaccctgagcaccctgacagtgacaagcgcccaccccgaggacagcagcttctacatctgtagcgccagcagcctggccagaagaagctacgagcagtacttcggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgaacatgctgaccgccagcctgctgagagccgtgatcgccagcatctgcgtggtgtccagcatggcccagaaagtgacccaggcccagaccgagatcagcgtggtggaaaaagaagatgtgaccctggactgcgtgtacgagacacgggacaccacctactacctgttctggtacaagcagcctcccagcggcgagctggtgttcctgatcagacggaacagcttcgacgagcagaacgagattagcggccggtacagctggaacttccagaagtccaccagcagcttcaacttcaccatcaccgcctcccaggtggtggacagcgccgtgtacttttgtgccctgtggaccggggccaacaacctgttctttggcaccggaacccggctgaccgtgatcccctatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 438 - DNA, 1878 bp, Homo sapiens
  TCR 21 Codon-optimized / cysteine-modified full sequence
atgcacagacctagaaggcccctgcatcccgtggcccctgccatgtctatcggcctgctgtgctgcgtggcattctccctgctgtgggcctctcctgtgaatgccggcgtgacccagacccctaagttccaggtgctgaaaaccggccagagcatgaccctgcagtgcgcccaggacatgaaccacaacagcatgtactggtacagacaggaccccggcatgggcctgcggctgatctactatagcgccagcgagggcaccaccgacaagggcgaggtgcccaacggctacaacgtgtcccggctgaacaagagagagttcagcctgagactggaaagcgccgctcccagccagaccagcgtgtacttctgtgccagcagaccctggggcaaccagaacaccgaggcattctttgggcagggcacccggctgacagtggtcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcgcgagggcagagtgaccggcggaggcaacaagctgacctttggcaccggcacccagctgaaagtggaactgaacatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 439 - DNA, 1854 bp, Homo sapiens
  TCR 22 Codon-optimized / cysteine-modified full sequence
atgggacctggactgctgtgctgggtgctgctgtgtctgctgggagccggacctgtggatgccggcgtgacacagagccccacccacctgatcaagaccagaggccagcacgtgaccctgcggtgtagccctatcagcggccacaagagcgtgtcctggtatcagcaggtcctgggccagggccctcagttcatcttccagtactacgagaaagaggaacgcggcagaggcaacttccccgacagattcagcgccagacagttccccaactacagcagcgagctgaacgtgaacgccctgctgctgggcgatagcgccctgtacctgtgtgccagcagccggaccgagaactacggctacaccttcggcagcggcaccagactgacagtggtcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatggcccaggaactgggcatgcagtgtcaggccagaggcatcctgcagcagatgtggggcgtgttcctgctgtacgtgtccatgaagatgggcggcaccaccggccagaacatcgaccagcctaccgagatgaccgccaccgagggcgctatcgtgcagatcaactgcacctaccagaccagcggcttcaacggcctgttctggtatcagcagcacgccggcgaggcccctaccttcctgagctacaatgtgctggacggcctggaagagaagggccggttcagcagcttcctgtccagaagcaagggctacagctacctgctgctgaaagaactgcagatgaaggacagcgcctcctacctgtgtgccgtgcgggccagaatggacagcaactaccagctgatctggggagccggcaccaagctgatcatcaagcccgacatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 440 - DNA, 1830 bp, Homo sapiens
  TCR 23 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcccctggggccagtctaatcagcctcagcacttcggcgacggcacccggctgtctattctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagcccacctggcggcagcgccagacagctgacatttggctctggcacccagctgaccgtgctgcccgatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 441 - DNA, 1839 bp, Homo sapiens
  TCR 24 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagccctttcggcagaggcagctacgagcagtacttcggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagggcagaggcgacagctggggcaagctgcagtttggagccggcacccaggtggtcgtgacccctgatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 442 - DNA, 1836 bp, Homo sapiens
  TCR 25 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggccagagcaatcagcctcagcacttcggcgacggcacccggctgtctattctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagggcagcctgaccggcggaggcaacaagctgacctttggcaccggcacccagctgaaagtggaactgaacatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 443 - DNA, 1833 bp, Homo sapiens
  TCR 26 Codon-optimized / cysteine-modified full sequence
atgtctctgggactgctgtgctgcggagccttctctctgctgtgggccggacctgtgaatgccggcgtgacccagacccctaagttccgggtgctgaaaaccggccagagcatgaccctgctgtgcgcccaggacatgaaccacgagtacatgtattggtacagacaggaccccggcatgggcctgcggctgatccactattctgtgggcgagggcaccaccgccaagggcgaagtgcctgacggctacaacgtgtcccggctgaagaagcagaacttcctgctgggcctggaaagcgccgctcctagccagaccagcgtgtacttctgcgccagcagctactacgccagcggccggaactacgagcagtacttcggccctggcacccggctgacagtgacagaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcgggacgcccggaacaacgacatgagattcggagccggcacccggctgaccgtgaagcctaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 444 - DNA, 1857 bp, Homo sapiens
  TCR 27 Codon-optimized / cysteine-modified full sequence
atgcacagacctagaaggcccctgcatcccgtggcccctgccatgtctatcggcctgctgtgctgcgtggcattctccctgctgtgggcctctcctgtgaatgccggcgtgacccagacccctaagttccaggtgctgaaaaccggccagagcatgaccctgcagtgcgcccaggacatgaaccacaacagcatgtactggtacagacaggaccccggcatgggcctgcggctgatctactatagcgccagcgagggcaccaccgacaagggcgaggtgcccaacggctacaacgtgtcccggctgaacaagagagagttcagcctgagactggaaagcgccgctcccagccagaccagcgtgtacttttgcgccagcagcgagttcggcagcctgaacgagaagctgttcttcggcagcggcacccagctgagcgtgctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgaagctggtcaccagcatcaccgtgctgctgagcctgggaatcatgggcgacgccaagaccacccagcccaacagcatggaaagcaacgaagaggaacccgtgcatctgccctgcaaccacagcaccatcagcggcaccgactacatccactggtacagacagctgcccagccagggccccgagtatgtgatccacggcctgaccagcaacgtgaacaaccggatggcctccctggccattgccgaggacagaaagagcagcaccctgatcctgcaccgggccacactgagagatgccgccgtgtactactgcatcctgcgggtgccacctcagagcggcggctaccagaaagtgaccttcggcaccggcaccaagctgcaggtcatccccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 445 - DNA, 1827 bp, Homo sapiens
  TCR 28 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggcagaagcagcggcaacaccatctacttcggcgagggcagctggctgaccgtggtcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgatgatcagcctgcgggtgctgctggtcatcctgtggctgcagctgagctgggtctggtcccagcggaaagaggtggaacaggaccctggccccttcaacgtgccagagggcgctaccgtggccttcaactgcacctacagcaacagcgccagccagagcttcttctggtacagacaggactgccggaaagaacccaagctgctgatgagcgtgtacagcagcggcaacgaggacggcagattcaccgcccagctgaaccgggccagccagtacatctccctgctgatccgggacagcaagctgagcgacagcgccacctatctgtgtgtcgtgcggggaggcggcaccagctacggcaagctgacatttggccagggcaccatcctgaccgtgcaccccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 446 - DNA, 1836 bp, Homo sapiens
  TCR 29 Codon-optimized / cysteine-modified full sequence
atgagcaatcaggtgctgtgctgcgtggtcctgtgcctgctgggagccaataccgtggatggcggcatcacccagagccccaagtacctgttccggaaagagggccagaacgtcaccctgagctgcgagcagaacctgaaccacgacgccatgtactggtacagacaggaccccggccagggcctgcggctgatctactacagccagatcgtgaacgacttccagaagggcgacattgccgagggctacagcgtgtccagagagaagaaagagtccttcccactgaccgtgaccagcgcccagaagaaccccaccgccttctacctgtgtgccagctctccttggggcagagccaccaacgagcagttcttcggccctggcaccaggctgacagtgctggaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcggctgaacaccggcaccgccagcaagctgaccttcggcacaggcaccagactgcaggtcacactggacatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 447 - DNA, 1818 bp, Homo sapiens
  TCR 30 Codon-optimized / cysteine-modified full sequence
atggatacctggctcgtgtgctgggccatcttcagcctgctgaaggccggactgaccgagcccgaagtgacccagacacccagccaccaggtcacacagatgggccaggaagtgatcctgcgctgcgtgcccatcagcaaccacctgtacttctactggtacagacagatcctgggccagaaggtggaattcctcgtcagcttctacaacaacgagatcagcgagaagtccgagattttcgacgaccagttcagcgtggaacggcccgacggcagcaacttcaccctgaagatcagaagcaccaagctcgaggacagcgccatgtacttttgcgccagcagcagacagcccagcagcggcaacaccatctacttcggcgagggcagctggctgaccgtggtcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgcggctggtggccagagtgaccgtgttcctgaccttcggcaccatcatcgacgccaagaccacccagcctcccagcatggattgtgccgagggcagagccgccaacctgccctgcaatcacagcaccatcagcggcaacgagtacgtgtactggtacagacagatccacagccagggccctcagtacatcatccacggcctgaagaacaacgagacaaacgagatggccagcctgatcatcaccgaggacagaaagagcagcaccctgatcctgccccacgccaccctgagagacaccgccgtgtactactgtatcgtgcggggcacaagcgtgctgcagggcaacgagaagctgacatttggcaccggcacccggctgaccatcatccccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 448 - DNA, 1845 bp, Homo sapiens
  TCR 31 Codon-optimized / cysteine-modified full sequence
atgggcaccagactgctgttctgggtggccttctgcctgctgggagccgatcatacaggtgccggcgtgtcccagagccccagcaacaaagtgaccgagaagggcaaggacgtggaactgagatgcgaccccatcagcggccacaccgccctgtactggtacagacagtctctgggccagggcctggaattcctgatctattttcagggcaacagcgcccctgacaagagcggcctgcccagcgatagattcagcgccgagagaacaggcggcagcgtgtccaccctgaccatccagagaacccagcaggaagatagcgccgtctacctgtgcgccagcagcagattcctgggcagcaccgacacccagtacttcggcccaggcaccaggctgacagtgctggaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatggccatgctgctgggagcctctgtgctgatcctgtggctccagcccgactgggtcaacagccagcagaagaacgacgaccagcaggtcaaacagaacagccccagcctgagcgtgcaggaaggccggatcagcatcctgaactgcgactacaccaacagcatgttcgactactttctgtggtacaagaagtaccccgccgagggccccaccttcctgatctccatcagcagcatcaaggacaagaacgaggacggccggttcaccgtgtttctgaacaagagcgccaagcacctgagcctgcacatcgtgcctagccagcctggcgacagcgccgtgtacttttgtgccgccagcgagcggggcacctacaagtacatcttcggcaccggcacccggctgaaggtgctggctaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 449 - DNA, 1809 bp, Homo sapiens
  TCR 32 Codon-optimized / cysteine-modified full sequence
atgggcttcagactgctgtgctgcgtggccttctgtctgctgggagccggacctgtggatagcggcgtgacccagacccctaagcacctgatcaccgccaccggccagcgcgtgacactgagatgtagccctagaagcggcgacctgagcgtgtactggtatcagcagagcctggaccagggcctgcagttcctgatccagtactacaacggcgaggaacgggccaagggcaacatcctggaacggttcagcgcccagcagttccccgatctgcacagcgagctgaacctgagcagcctggaactgggcgacagcgccctgtacttctgtgcctcttctgtgggcggcgaccacagcgacgagcagttttttggccctggcacccggctgaccgtgctggaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatggtgctgaagttcagcgtgtccatcctgtggatccagctggcctgggtgtccacccagctgctggaacagagccctcagttcctgagcatccaggaaggcgagaacctgaccgtgtactgcaacagcagcagcgtgttcagcagcctgcagtggtacagacaggaacccggcgagggacctgtgctgctggtcacagtcgtgacaggcggcgaagtgaagaagctgaagcggctgaccttccagttcggcgacgccagaaaggacagctccctgcacattacagccgcccagcctggcgataccggcctgtatctgtgtgccggcggaagcaactacaagctgacctttggcaagggcaccctgctgaccgtgaaccccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 450 - DNA, 1830 bp, Homo sapiens
  TCR 33 Codon-optimized / cysteine-modified full sequence
atggatacctggctcgtgtgctgggccatcttcagcctgctgaaggccggactgaccgagcccgaagtgacccagacacccagccaccaggtcacacagatgggccaggaagtgatcctgcgctgcgtgcccatcagcaaccacctgtacttctactggtacagacagatcctgggccagaaggtggaattcctcgtcagcttctacaacaacgagatcagcgagaagtccgagattttcgacgaccagttcagcgtggaacggcccgacggcagcaacttcaccctgaagatcagaagcaccaagctcgaggacagcgccatgtacttttgcgccagcacccctcgggacacctacgagcagtacttcggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgatgaagtccctgcgggtgctgctggtcatcctgtggctgcagctgagctgggtctggtcccagcagaaagaggtggaacagaacagcggcccactgagcgtgccagagggcgctatcgccagcctgaactgcacctacagcgaccggggcagccagagcttcttctggtacagacagtacagcggcaagagccccgagctgatcatgttcatctacagcaacggcgacaaagaggacggccggttcaccgcccagctgaacaaggccagccagtacgtgtccctgctgatcagagacagccagcccagcgacagcgccacctacctgtgtgccgtgaatgcccaccacaccggcggcttcaagaccatctttggagccggcacccggctgttcgtgaaggccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 451 - DNA, 1806 bp, Homo sapiens
  TCR 34 Codon-optimized / cysteine-modified full sequence
atgggacctggactgctgtgttgggccctgctgtgtctgctgggagccggatctgtggaaaccggcgtgacccagagccccacccacctgatcaagaccagaggccagcaggtcacactgcggtgtagcagccagagcggccacaacaccgtgtcctggtatcagcaggccctgggccagggaccccagttcatcttccagtactaccgcgaggaagagaacggcagaggcaacttcccaccccggttcagcggcctgcagttccccaattacagcagcgagctgaacgtgaacgccctggaactggacgacagcgccctgtacctgtgcgcctctagcagctacgccggcagctacgagcagtacttcggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgaagaaactgctggccatgatcctgtggctgcagctggacagactgagcggcgagctgaaggtggaacagaaccctctgttcctgagcatgcaggaaggcaagaactacaccatctactgcaactacagcaccaccagcgaccggctgtactggtacagacaggaccccggcaagagcctggaaagcctgttcgtgctgctgagcaacggggccgtgaagcaggaaggacggctgatggccagcctggacaccaaggccagactgtccaccctgcacatcacagccgccgtgcacgacctgagcgccacctacttttgtgccgtgtccggcacctacaagtacatcttcggcaccggcaccagactgaaggtgctggccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 452 - DNA, 1818 bp, Homo sapiens
  TCR 35 Codon-optimized / cysteine-modified full sequence
atgggctttagactgctgtgctgcgtggccttctgtctgcttggagctggccctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagcaccacaagcggcgatagcagctacaacgagcagttcttcggccctggcaccagactgacagttctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggctctgcagtctacactgggagctgtgtggctgggcctgctgctgaattctctgtggaaggtggccgagagcaaggaccaggtgttccagccttctacagtggcctcttctgagggcgccgtggtggaaatcttctgcaaccacagcgtgtccaacgcctacaacttcttctggtatctgcacttccccggctgcgcccctagactgcttgtgaagggaagcaagcctagccagcagggcagatacaacatgacctacgagcggttcagcagctccctgctgattctgcaagtgcgggaagccgatgccgccgtgtattattgtgctgtggccggcgactacaagctgagctttggagccggcaccacagtgacagtgcgggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 453 - DNA, 1824 bp, Homo sapiens
  TCR 36 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatgaccggcagaagcaactacgagcagtacttcggccctggcaccagactgacagtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgatcagcctgcgggtgctgctggtcatcctgtggctgcaactgagctgggtctggtcccagcggaaagaggtggaacaggaccccggacctttcaatgtgcctgaaggcgccaccgtggccttcaactgcacctacagcaatagcgccagccagagcttcttctggtacagacaggactgccggaaagaacccaagctgctgatgagcgtgtacagcagcggcaacgaggacggcagattcacagcccagctgaacagagccagccagtacatctccctgctgatccgggatagcaagctgagcgatagcgccacctacctgtgcgtggtcaacagagacaactacggccagaacttcgtgttcggccctggcacaagactgagcgtgctgccttatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 454 - DNA, 1812 bp, Homo sapiens
  TCR 37 Codon-optimized / cysteine-modified full sequence
atgggaacaagactgctgtgttgggtcgtgctgggcttcctgggcacagatcatacaggtgccggtgtctctcagagccccagatacaaggtggccaagcgcggacaggatgtggccctgagatgtgatcctatcagcggccacgtgtccctgttctggtatcagcaggctctcggacagggccccgagttcctgacctactttcagaatgaggcccagctggacaagagcggcctgcctagcgatagattcttcgccgaaagacccgagggcagcgtgtccacactgaagatccagagaacccagcaagaggacagcgccgtgtacctgtgtgcctctagtctgctgctgggcgcctacggctacacatttggctctggcaccagactgaccgtggtcgaggacctgaataaggtgttccctccagaggtggccgtgttcgagccttctgaggccgagatcagccacacacagaaagccacactcgtgtgcctggccaccggcttttttcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgtgtcctatcagcagggcgtgctgtctgccaccatcctgtatgagatcctgctgggcaaagccactctgtacgccgtgctggtgtctgccctggtgctgatggccatggtcaagagaaaggactttggcagcggcgccaccaacttcagcctgcttaaacaagctggcgacgtggaggagaatcctggcccaatgaagaaactgctggccatgatcctgtggctgcagctggatagactgagcggcgagctgaaggtggaacagaaccctctgttcctgagcatgcaagagggcaagaactacaccatctactgcaactacagcaccaccagcgaccggctgtactggtacagacaggatccaggcaagagcctggaaagcctgttcgtgctgctgagcaatggcgccgtgaaacaagagggtagactgatggccagcctggacaccaaggccagactgagcacactgcacattacagccgccgtgcacgatctgagcgccacctatttttgtgccggctactctggcgccggaagctaccagctgacatttggcaagggcaccaagctgagcgtgatccccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 455 - DNA, 1839 bp, Homo sapiens
  TCR 38 Codon-optimized / cysteine-modified full sequence
atgggacctggactgctttgttgggtgctgctgtgtctgctcggagccggatctgtggaaacaggcgtgacacagagccccacacacctgatcaagaccagaggccagcaagtgaccctgagatgcagctctcagagcggccacaataccgtgtcctggtatcagcaggccctcggacagggccctcagttcatcttccagtactacagagaggaagagaacggcagaggcaacttcccacctagattcagcggcctgcagttccccaactacagcagcgagctgaacgtgaacgccctggaactggatgacagcgccctgtacctgtgtgcctcttctcttgtggctggcggcgagacacagtactttggccccggaacaagactgctggtgctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggtcaagatgcctggcgctagacggcagagcatcatgaagagaattctgggcgccctgctgggcctgctgtctgcccaagtttgttgtgtgcggggcatccaggtggaacagagccctcctgatctgatcctgcaagagggcgccaacagcaccctgagatgcaacttcagcgacagcgtgaacaacctgcagtggttccaccagaatccttggggccagctgatcaacctgttctacatccccagcggcaccaagcagaacggcagactgtctgctaccaccgtggccaccgagagatacagcctgctgtacatcagcagcagccagaccacagacagcggcgtgtacttttgcgccgtgggcttcaacgacatgagattcggagccggcaccagactgaccgtgaagcctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 456 - DNA, 1779 bp, Homo sapiens
  TCR 39 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacacccagagacagaggcaaagaggccttcttcggccaaggcaccagactgacagtggtcgaggacctgaataaggtgttccctccagaggtggccgtgttcgagccttctgaggccgagatcagccacacacagaaagccacactcgtgtgcctggccaccggcttttttcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgtgtcctatcagcagggcgtgctgtctgccaccatcctgtatgagatcctgctgggcaaagccactctgtacgccgtgctggtgtctgccctggtgctgatggccatggtcaagagaaaggactttggcagcggcgccaccaacttcagcctgcttaaacaagctggcgacgtggaggagaatcctggcccaatgcagctgacatgggtttccggccagcagctgaatcagagccctcagagcatgttcatccaagaaggcgaggacgtttccatgaactgcaccagcagcagcatcttcaacacctggctgtggtacaagcaagagcctggcgaaggacccgtgctgctgatcgctctttacaaggccggcgagctgaccagcaacggcagactgacagcccagttcggcattacccggaaggacagcttcctgaacatcagcgccagcattcccagcgacgtgggcatctatttctgcgccggctacagcagctccaacgactacaagctgagcttcggagccggcaccaccgtgacagttagagccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 457 - DNA, 1917 bp, Homo sapiens
  TCR 40 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatcaccgccagaagcagctacgagcagtatttcggccctggcaccagactgaccgtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctacttttgcgccggcagaaacaacttcaacaagttctacttcggcagcggcaccaagctgaacgtgaagcccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 458 - DNA, 1833 bp, Homo sapiens
  TCR 41 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaatccccgggacagagtgtcctacgagcagtactttggccctggcaccagactgaccgtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgatcagcctgcgggtgctgctggtcatcctgtggctgcaactgagctgggtctggtcccagcggaaagaggtggaacaggaccccggacctttcaatgtgcctgaaggcgccaccgtggccttcaactgcacctacagcaatagcgccagccagagcttcttctggtacagacaggactgccggaaagaacccaagctgctgatgagcgtgtacagcagcggcaacgaggacggcagattcacagcccagctgaacagagccagccagtacatctccctgctgatccgggatagcaagctgagcgatagcgccacctacctgtgcgtggtcacatttgctctgaccggcggcttcaagaccatcttcggagccggcaccagactgttcgtgaaggccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 459 - DNA, 1917 bp, Homo sapiens
  TCR 42 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccaagaccagcagaagcagctacgagcagtacttcggccctggcaccagactgacagtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctacttttgcgccggacctgacaacttcaacaagttctacttcggcagcggcaccaagctgaacgtgaagcccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 460 - DNA, 1830 bp, Homo sapiens
  TCR 43 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacacccagagacagctacgagcagtatttcggccctggcaccagactgaccgtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgtgccgtgaatgtgcctaccagcggcacctacaagtacatcttcggcaccggcaccagactgaaggtgctggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 461 - DNA, 1851 bp, Homo sapiens
  TCR 44 Codon-optimized / cysteine-modified full sequence
atgggctttagactgctgtgctgcgtggccttctgtctgcttggagctggccctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagcagcggcacacccgacacacagtattttggccctggcaccagactgaccgtgctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgtgcccagtactctggcggctaccagaaagtgacctttggcaccggcaccaagctgcaagtgatccccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 462 - DNA, 1929 bp, Homo sapiens
  TCR 45 Codon-optimized / cysteine-modified full sequence
atgggaaccagactgctgttctgggtcgccttctgtctgctgggcgcctatcatacaggtgccggtgtctctcagagccccagcaacaaagtgaccgagaagggcaaagacgtggaactgagatgcgaccccatcagcggacacacagccctgtactggtacagacagagactcggccagggcctcgagttcctgatctacttccaaggcaacagcgcccctgacaagagcggcctgcctagcgatagattcagcgccgagagaacaggcgagagcgtgtccacactgaccatccagagaacccagcaagaggacagcgccgtgtacctgtgtgccagctctctgtacctgggaaccaccggcgagctgttctttggcgagggctctagactgaccgtgctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctatttttgcgccggatcttctggcgccggaagctaccagctgacatttggcaagggcaccaagctgagcgtgatccccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 463 - DNA, 1830 bp, Homo sapiens
  TCR 46 Codon-optimized / cysteine-modified full sequence
atgggaacaagactgctgtgttgggccgctctgtgtctgctgggagctgatcatacaggcgccggtgtcagccagacacctagcaacaaagtgaccgagaagggcaaatacgtggaactgagatgcgaccccatcagcggacacacagccctgtactggtacagacagtctctcggccagggacctgagttcctgatctacttccaaggcaccggcgctgccgatgatagcggcctgcctaacgatagattcttcgccgtcagacccgagggcagcgtgtccacactgaagatccagagaaccgagaggggcgacagcgccgtgtatctgtgtgccagctctctgtatctcggcggcagcgagacacagtactttggccctggtacacggctgctggttctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgctgctgcttctggtgcccgccttccaagtgatctttaccctcggcggaacacgggcccagtctgtgacacagctggattctcaggtgcccgtgtttgaggaagcccctgtcgagctgagatgcaactacagcagcagcgtgtccgtgtacctgttttggtacgtgcagtaccccaaccagggcctgcagctgctgctcaagtatctgagcggcagcacactggtcaagggcatcaatggcttcgaggccgagttcaacaagagccagaccagcttccatctgcggaagcccagcgtgcacatcagcgataccgccgagtacttctgcgccgtgtctcctagcagcggcacctacaagtacatcttcggcaccggcaccagactgaaggtgctggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 464 - DNA, 1830 bp, Homo sapiens
  TCR 47 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatgaccggcagaaccacctacgagcagtatttcggccctggcaccagactgaccgtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgtgccgtgaatctgctgagcggcagcgctagacagctgacatttggctctggcacccagctgaccgtgctgcctgatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 465 - DNA, 1824 bp, Homo sapiens
  iDNA (0)...(0): TCR 48 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaccggcagagtgtcctacgagcagtatttcggccctggcaccagactgaccgtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgaagtccctgcgggtgctgctggtcatcctgtggctgcaactgagctgggtctggtcccagcagaaagaggtggaacaggaccctggacctctgtctgttcctgagggcgccatcgtgtccctgaactgcacctacagcaacagcgccttccagtacttcatgtggtacagacagtacagccggaagggccccgagctgctgatgtacacatacagcagcggcaacaaagaggacggccggtttacagcccaggtggacaagagcagcaagtacatctccctgttcatccgggacagccagcctagcgatagcgccacatatctgtgcgccatgagaatccagggcgcccagaaactggtgttcggccagggaaccagactgaccatcaatcccaacatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 466 - DNA, 1830 bp, Homo sapiens
  TCR 49 Codon-optimized / cysteine-modified full sequence
atggatacctggctcgtgtgctgggccatcttcagcctgctgaaagccggactgaccgagcctgaagtgacccagacacctagccaccaagtgacacagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacaccccggtacagctacgagcagtatttcggccctggcaccagactgaccgtgacagaagatctgaagaacgtcttccctcctgaagtggccgtgtttgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggccggcgacgtggaggagaatcctggcccaatgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgcgccgtgaatatcggcaccagcggcacctacaagtacatcttcggcaccggcaccagactgaaggtgctggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 467 - DNA, 1815 bp, Homo sapiens
  TCR 50 Codon-optimized / cysteine-modified full sequence
atgggcttcagactgctgtgctgcgtggccttttgtctgcttggagccggacctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccactactacaacggcgaggaaagagccaagggcaacatcctggaacggttcagcgcccagcagttcccagatctgcacagcgagctgaacctgagcagcctggaactgggagatagcgccctgtacttctgtgccagcagcgccacaagagatgcctacggctacacatttggcagcggcaccagactgacagtggtggaggacctgaataaggtgttccctcctgaagtggccgtgtttgagccttctgaggccgagatcagccacacacagaaagccacactcgtgtgcctggccaccggcttttttcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgtgtcctatcagcagggcgtgctgtctgccaccatcctgtatgagatcctgctgggcaaagccactctgtacgccgtgctggtgtctgccctggtgctgatggccatggtcaagagaaaggactttggcagcggcgccaccaacttcagcctgcttaaacaggcaggcgacgtggaggagaatcctggcccaatgaagaccttcgccggcttcagcttcctgttcctgtggctgcagctggactgcatgagcagaggcgaggatgtggaacagagcctgtttctgagcgtccgcgagggcgatagcagcgtgatcaattgcacctacaccgacagcagcagcacctacctgtactggtacaagcaagagcctggcgccggactgcagctgctgacctacatcttcagcaacatggacatgaagcaggaccagcggctgaccgtgctgctgaacaagaaggacaagcacctgagcctgcggatcgccgatacacagacaggcgacagcgccatctacttttgcgccgagtctcctccaggcacctacaagtacatcttcggcaccggcaccagactgaaggtgctggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 468 - DNA, 1833 bp, Homo sapiens
  TCR 51 Codon-optimized / cysteine-modified full sequence
atggatacctggctcgtgtgctgggccatcttcagcctgctgaaagccggactgaccgagcctgaagtgacccagacacctagccaccaagtgacacagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccattgccagccgggtgtcctacgagcagtatttcggccctggcaccagactgaccgtgacagaagatctgaagaacgtcttccctcctgaagtggccgtgtttgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggccggcgacgtggaggagaatcctggcccaatgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgagcatctacagcaacggcgacaaagaggacggccggtttacagcccagctgaacaaggccagccagtacgtgtccctgctgatcagagatagccagcctagcgacagcgccacctatctgtgcgccgtgaatatgagaggcggcggaagcaactacaagctgacctttggcaagggcaccctgctgaccgtgaatcccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 469 - DNA, 1806 bp, Homo sapiens
  TCR 52 Codon-optimized / cysteine-modified full sequence
atgggcttcagactgctgtgctgcgtggccttttgtctgcttggagccggacctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagctctgtgggcgatctgaacaacgagcagttcttcggccctggcaccagactgacagttctggaagatctgaagaacgtcttccctcctgaagtggccgtgtttgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggccggcgacgtggaggagaatcctggcccaatggtgctgaagttcagcgtgtccatcctgtggatccagctggcctgggtttccacacagctgctggaacagagccctcagttcctgagcatccaagagggcgagaacctgaccgtgtactgcaacagcagcagcgtgttcagcagcctgcagtggtacagacaagagcctggcgaaggacctgtgctgctggtcacagttgtgacaggcggcgaagtgaagaagctgaagcggctgaccttccagttcggcgacgccagaaaggatagctccctgcacattaccgctgctcagccaggcgataccggcctgtatctttgtgccggcgctcgggattacaagctgtcttttggcgccggaaccaccgtgacagtgcgggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 470 - DNA, 1836 bp, Homo sapiens
  TCR 53 Codon-optimized / cysteine-modified full sequence
atgggcacaagcctgctgtgttgggtcgtgctgggctttctgggcacagatcatacaggcgccggtgtcagccagtctcctcggtacaaagtgaccaagcgcggacaggatgtggccctgagatgcgatcctatctctggccacgtgtccctgtactggtacagacaggctctcggacagggccccgagttcctgacctacttcaattacgaggcccagcaggacaagagcggcctgcctaacgatagattcagcgccgaaagacccgagggcagcatcagcacactgaccatccagagaaccgagcagagggacagcgccatgtacagatgtgcctctagcggcagcggcaccagcggctacaatgagcagtttttcggccctggcaccagactgacagtgctggaagatctgaagaacgtcttccctcctgaagtggccgtgtttgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggccggcgacgtggaggagaatcctggcccaatggccagcgctcctatctctatgctggccatgctgttcaccctgagcggactgagagcacagtctgtggcccagcctgaggaccaagtgaatgtggccgagggcaatcccctgaccgtgaagtgtacctacagcgtgtccggcaatccctacctgttttggtacgtgcagtaccccaaccggggcctgcagttcctgctgaagtacatcaccggcgacaacctggtcaagggcagctatggattcgaggccgagttcaacaagagccagaccagcttccacctgaagaaacccagcgctctggtgtccgatagcgccctgtatttctgcgccgtcagagattttggcagcggcacctacaagtacatcttcggcaccggcaccagactgaaggtgctggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 471 - DNA, 1821 bp, Homo sapiens
  TCR 54 Codon-optimized / cysteine-modified full sequence
atggatacttggctcgtgtgctgggccatcttcagcctgctgaaagccggactgaccgagcctgaagtgacacagacacctagccaccaagtgacccagatgggccaagaggtcatactgagatgcgtgcccatcagcaaccacctgtacttctactggtacagacagatcctgggccagaaggtggaattcctcgtcagcttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatcaccgaccggaccaactacggctacacatttggcagcggcaccagactgacagtggtcgaggacctgaataaggtgttccctcctgaagtggccgtgtttgagccttctgaggccgagatcagccacacacagaaagccacactcgtgtgcctggccaccggcttttttcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgtgtcctatcagcagggcgtgctgtctgccaccatcctgtatgagatcctgctgggcaaagccactctgtacgccgtgctggtgtctgccctggtgctgatggccatggtcaagagaaaggactttggcagcggcgccaccaacttcagcctgcttaaacaggcaggcgacgtggaggagaatcctggcccaatgaagaagcacctgaccacctttctggtcatcctgtggctgtacttctacagaggcaacggcaagaaccaggtggaacagagccctcagagcctgatcatcctggaaggcaagaactgcaccctgcagtgcaactacaccgtgtctcccttcagcaacctgcggtggtacaagcaggatacaggcagaggccctgtgtctctgaccatcatgaccttcagcgagaacaccaagagcaacggcagatacaccgccacactggacgccgatacaaagcagagcagcctgcacatcacagccagccagctgagcgatagcgccagctacatctgcgtggtgtccagagacaactacggccagaacttcgtgttcggccctggcacaagactgagcgtgctgccttatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 472 - DNA, 1821 bp, Homo sapiens
  TCR 55 Codon-optimized / cysteine-modified full sequence
atggatacttggctcgtgtgctgggccatcttcagcctgctgaaagccggactgaccgagcctgaagtgacacagacacctagccaccaagtgacccagatgggccaagaggtcatactgagatgcgtgcccatcagcaaccacctgtacttctactggtacagacagatcctgggccagaaggtggaattcctcgtcagcttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaccaccagaagcagctacgagcagtatttcggccctggcaccagactgaccgtgacagaagatctgaagaacgtcttccctcctgaagtggccgtgtttgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggccggcgacgtggaggagaatcctggcccaatgaagaccttcgccggcttcagcttcctgttcctgtggctgcagctggactgtatgagcagaggcgaggatgtggaacagagcctgtttctgagcgtcagagaaggcgacagcagcgtgatcaactgcacctacaccgacagctccagcacctacctgtactggtacaagcaagaacctggcgccggactgcagctgctgacctacatcttcagcaacatggacatgaagcaggaccagcggctgaccgtgctgctgaacaagaaggataagcacctgagcctgcggatcgccgatacacagacaggcgactccgccatctacttttgtgctgtgcctagcggcgccaccaacaagctgatctttggaacaggcacactgctggccgtgcagcccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 473 - protein, 255 aa, Homo sapiens
  TCR 15 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 474 - protein, 255 aa, Homo sapiens
  TCR 15 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 475 - protein, 275 aa, Homo sapiens
  TCR 15 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 476 - protein, 275 aa, Homo sapiens
  TCR 15 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 477 - protein, 114 aa, Homo sapiens
  TCR 15 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHP

SEQ ID NO: 478 - protein, 11 aa, Homo sapiens
  TCR 15 alpha CDR3
AMKPGGYNKLI

SEQ ID NO: 479 - protein, 294 aa, Homo sapiens
  TCR 15 - Beta Native
DAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 480 - protein, 294 aa, Homo sapiens
  TCR 15 - Beta Cysteine-modified
DAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 481 - protein, 313 aa, Homo sapiens
  TCR 15 - Beta Native
MDSWTFCCVSLCILVAKHTDAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 482 - protein, 313 aa, Homo sapiens
  TCR 15 - Beta Cysteine-modified
MDSWTFCCVSLCILVAKHTDAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 483 - protein, 115 aa, Homo sapiens
  TCR 15 Beta variable region
DAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVT

SEQ ID NO: 484 - protein, 5 aa, Homo sapiens
  TCR 15 Beta CDR1
SGHNS

SEQ ID NO: 485 - protein, 6 aa, Homo sapiens
  TCR 15 Beta CDR2
FNNNVP

SEQ ID NO: 486 - protein, 13 aa, Homo sapiens
  TCR 15 Beta CDR3
ASSLVGRSRTEQY

SEQ ID NO: 487 - protein, 19 aa, Homo sapiens
  TCR 15 - Beta signal peptide
MDSWTFCCVSLCILVAKHT

SEQ ID NO: 488 - protein, 253 aa, Homo sapiens
  TCR 16 - Alpha Native
KQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 489 - protein, 253 aa, Homo sapiens
  TCR 16 - Alpha Cysteine-modified
KQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 490 - protein, 272 aa, Homo sapiens
  TCR 16 - Alpha Native
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 491 - protein, 272 aa, Homo sapiens
  TCR 16 - Alpha Cysteine-modified
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 492 - protein, 112 aa, Homo sapiens
  TCR 16 Alpha variable region
KQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKP

SEQ ID NO: 493 - protein, 11 aa, Homo sapiens
  TCR 16 alpha CDR3
AVRPANNNDMR

SEQ ID NO: 494 - protein, 291 aa, Homo sapiens
  TCR 16 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 495 - protein, 291 aa, Homo sapiens
  TCR 16 / TCR 17 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 496 - protein, 310 aa, Homo sapiens
  TCR 16 / TCR 17 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 497 - protein, 310 aa, Homo sapiens
  TCR 16 / TCR 17 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 498 - protein, 114 aa, Homo sapiens
  TCR 16 / TCR 17 - Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSIL

SEQ ID NO: 499 - protein, 13 aa, Homo sapiens
  TCR 16 / TCR 17  Beta CDR3
ASSLWGRSNQPQH

SEQ ID NO: 500 - protein, 255 aa, Homo sapiens
  TCR 17 - Alpha Native
AQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 501 - protein, 255 aa, Homo sapiens
  TCR 17 - Alpha Cysteine-modified
AQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 502 - protein, 275 aa, Homo sapiens
  TCR 17 - Alpha Native
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 503 - protein, 275 aa, Homo sapiens
  TCR 17 - Alpha Cysteine-modified
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 504 - protein, 114 aa, Homo sapiens
  TCR 17 - Alpha variable region
AQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILP

SEQ ID NO: 505 - protein, 11 aa, Homo sapiens
  TCR 17 Alpha CDR3
AMREGRGDKII

SEQ ID NO: 506 - protein, 256 aa, Homo sapiens
  TCR 18 - Alpha Native
KQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 507 - protein, 256 aa, Homo sapiens
  TCR 18 - Alpha Cysteine-modified
KQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 508 - protein, 275 aa, Homo sapiens
  TCR 18 - Alpha Native
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 509 - protein, 275 aa, Homo sapiens
  TCR 18 - Alpha Cysteine-modified
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 510 - protein, 115 aa, Homo sapiens
  TCR 18 Alpha variable region
KQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHP

SEQ ID NO: 511 - protein, 14 aa, Homo sapiens
  TCR 18 Alpha CDR3
AEGNAGGTSYGKLT

SEQ ID NO: 512 - protein, 291 aa, Homo sapiens
  TCR 18 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 513 - protein, 291 aa, Homo sapiens
  TCR 18 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 514 - protein, 310 aa, Homo sapiens
  TCR 18 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 515 - protein, 310 aa, Homo sapiens
  TCR 18 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 516 - protein, 114 aa, Homo sapiens
  TCR 18 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVT

SEQ ID NO: 517 - protein, 13 aa, Homo sapiens
  TCR 18 Beta CDR3
ASSFWGRSNSPLH

SEQ ID NO: 518 - protein, 257 aa, Homo sapiens
  TCR 19 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 519 - protein, 257 aa, Homoe sapiens
  TCR 19 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 520 - protein, 277 aa, Homo sapiens
  TCR 19 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 521 - protein, 277 aa, Homo sapiens
  TCR 19 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 522 - protein, 116 aa, Homo sapiens
  TCR 19 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTL

SEQ ID NO: 523 - protein, 13 aa, Homo sapiens
  TCR 19  Alpha CDR3
AMRENTGTASKLT

SEQ ID NO: 524 - protein, 141 aa, Homo sapiens
  TCR 19/ TCR 22/ TCR 23/ TCR 24/ TCR 25/ TCR 47 Native TCR alpha constant region
DIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 525 - protein, 141 aa, Homo sapiens
  TCR 19/ TCR 22/ TCR 23/ TCR 24/ TCR 25/ TCR 29/ TCR 47 Alpha constant region
DIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 526 - protein, 293 aa, Homo sapiens
  TCR 19 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 527 - protein, 293 aa, Homo sapiens
  TCR 19 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 528 - protein, 312 aa, Homo sapiens
  TCR 19 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 529 - protein, 312 aa, Homo sapiens
  TCR 19 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 530 - protein, 114 aa, Homo sapiens
  TCR 19 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVT

SEQ ID NO: 531 - protein, 13 aa, Homo sapiens
  TCR 19 Beta CDR3
ASSSWGQSTGEQY

SEQ ID NO: 532 - protein, 254 aa, Homo sapiens
  TCR 20 - Alpha Native
AQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 533 - protein, 254 aa, Homo sapiens
  TCR 20 - Alpha Cysteine-modified
AQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 534 - protein, 276 aa, Homo sapiens
  TCR 20 - Alpha Native
MNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 535 - protein, 276 aa, Homo sapiens
  TCR 20 - Alpha Cysteine-modified
MNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 536 - protein, 113 aa, Homo sapiens
  TCR 20 Alpha variable region
AQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIP

SEQ ID NO: 537 - protein, 7 aa, Homo sapiens
  TCR 20 Alpha CDR1
TRDTTYY

SEQ ID NO: 538 - protein, 8 aa, Homo sapiens
  TCR 20 Alpha CDR2
RNSFDEQN

SEQ ID NO: 539 - protein, 10 aa, Homo sapiens
  TCR 20 Alpha CDR3
ALWTGANNLF

SEQ ID NO: 540 - protein, 22 aa, Homo sapiens
  TCR 20 alpha signal peptide
MNMLTASLLRAVIASICVVSSM

SEQ ID NO: 541 - protein, 296 aa, Homo sapiens
  TCR 20 - Beta Native
GAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 542 - protein, 296 aa, Homo sapiens
  TCR 20 - Beta Cysteine-modified
GAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 543 - protein, 310 aa, Homo sapiens
  TCR 20 - Beta Native
MLLLLLLLGPGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 544 - protein, 310 aa, Homo sapiens
  TCR 20 - Beta Cysteine-modified
MLLLLLLLGPGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 545 - protein, 117 aa, Homo sapiens
  TCR 20 Beta variable region
GAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVT

SEQ ID NO: 546 - protein, 6 aa, Homo sapiens
  TCR 20 Beta CDR1
DFQATT

SEQ ID NO: 547 - protein, 7 aa, Homo sapiens
  TCR 20 Beta CDR2
SNEGSKA

SEQ ID NO: 548 - protein, 13 aa, Homo sapiens
  TCR 20 Beta CDR3
SASSLARRSYEQY

SEQ ID NO: 549 - protein, 14 aa, Homo sapiens
  TCR 20 beta signal peptide
MLLLLLLLGPGSGL

SEQ ID NO: 550 - protein, 259 aa, Homo sapiens
  TCR 21 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 551 - protein, 259 aa, Homo sapiens
  TCR 21 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 552 - protein, 279 aa, Homo sapiens
  TCR 21 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 553 - protein, 279 aa, Homo sapiens
  TCR 21 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 554 - protein, 118 aa, Homo sapiens
  TCR 21 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVEL

SEQ ID NO: 555 - protein, 15 aa, Homo sapiens
  TCR 21 Alpha CDR3
AMREGRVTGGGNKLT

SEQ ID NO: 556 - protein, 291 aa, Homo sapiens
  TCR 21 - Beta Native
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 557 - protein, 291 aa, Homo sapiens
  TCR 21 - Beta Cysteine-modified
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 558 - protein, 324 aa, Homo sapiens
  TCR 21 - Beta Native
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 559 - protein, 324 aa, Homo sapiens
  TCR 21 - Beta Cysteine-modified
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 560 - protein, 114 aa, Homo sapiens
  TCR 21 Beta variable region
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVV

SEQ ID NO: 561 - protein, 5 aa, Homo sapiens
  TCR 21/ TCR 27 Beta CDR1
MNHNS

SEQ ID NO: 562 - protein, 6 aa, Homo sapiens
  TCR 21/ TCR 27 Beta CDR2
SASEGT

SEQ ID NO: 563 - protein, 13 aa, Homo sapiens
  TCR 21 Beta CDR3
ASRPWGNQNTEAF

SEQ ID NO: 564 - protein, 33 aa, Homo sapiens
  TCR 21/ TCR 27 Beta signal peptide
MHRPRRPLHPVAPAMSIGLLCCVAFSLLWASPV

SEQ ID NO: 565 - protein, 253 aa, Homo sapiens
  TCR 22 - Alpha Native
GQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 566 - protein, 253 aa, Homo sapiens
  TCR 22 - Alpha Cysteine-modified
GQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 567 - protein, 287 aa, Homo sapiens
  TCR 22 - Alpha Native
MAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 568 - protein, 287 aa, Homo sapiens
  TCR 22 - Alpha Cysteine-modified
MAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 569 - protein, 112 aa, Homo sapiens
  TCR 22 Alpha variable region
GQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKP

SEQ ID NO: 570 - protein, 6 aa, Homo sapiens
  TCR 22/ TCR 44 Alpha CDR1
TSGFNG

SEQ ID NO: 571 - protein, 6 aa, Homo sapiens
  TCR 22/ TCR 44 Alpha CDR2
NVLDGL

SEQ ID NO: 572 - protein, 13 aa, Homo sapiens
  TCR 22 Alpha CDR3
AVRARMDSNYQLI

SEQ ID NO: 573 - protein, 34 aa, Homo sapiens
  TCR 22/ TCR 44Alpha signal peptide
MAQELGMQCQARGILQQMWGVFLLYVSMKMGGTT

SEQ ID NO: 574 - protein, 289 aa, Homo sapiens
  TCR 22 - Beta Native
DAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 575 - protein, 289 aa, Homo sapiens
  TCR 22 - Beta Cysteine-modified
DAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 576 - protein, 308 aa, Homo sapiens
  TCR 22 - Beta Native
MGPGLLCWVLLCLLGAGPVDAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 577 - protein, 308 aa, Homo sapiens
  TCR 22 - Beta Cysteine-modified
MGPGLLCWVLLCLLGAGPVDAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 578 - protein, 112 aa, Homo sapiens
  TCR 22 Beta variable region
DAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVV

SEQ ID NO: 579 - protein, 5 aa, Homo sapiens
  TCR 22 Beta CDR1
SGHKS

SEQ ID NO: 580 - protein, 6 aa, Homo sapiens
  TCR 22 Beta CDR2
YYEKEE

SEQ ID NO: 581 - protein, 11 aa, Homo sapiens
  TCR 22 Beta CDR3
ASSRTENYGYT

SEQ ID NO: 582 - protein, 19 aa, Homo sapiens
  TCR 22 Beta signal peptide
MGPGLLCWVLLCLLGAGPV

SEQ ID NO: 583 - protein, 257 aa, Homo sapiens
  TCR 23 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 584 - protein, 257 aa, Homo sapiens
  TCR 23 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 585 - protein, 277 aa, Homo sapiens
  TCR 23 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 586 - protein, 277 aa, Homo sapiens
  TCR 23 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 587 - protein, 116 aa, Homo sapiens
  TCR 23 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLP

SEQ ID NO: 588 - protein, 13 aa, Homo sapiens
  TCR 23 Alpha CDR3
AMSPPGGSARQLT

SEQ ID NO: 589 - protein, 291 aa, Homo sapiens
  TCR 23 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 590 - protein, 291 aa, Homo sapiens
  TCR 23 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 591 - protein, 310 aa, Homo sapiens
  TCR 23 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 592 - protein, 310 aa, Homo sapiens
  TCR 23 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 593 - protein, 114 aa, Homo sapiens
  TCR 23 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSIL

SEQ ID NO: 594 - protein, 13 aa, Homo sapiens
  TCR 23 Beta CDR3
ASSPWGQSNQPQH

SEQ ID NO: 595 - protein, 258 aa, Homo sapiens
  TCR 24 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 596 - protein, 258 aa, Homo sapiens
  TCR 24 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 597 - protein, 278 aa, Homo sapiens
  TCR 24 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 598 - protein, 278 aa, Homo sapiens
  TCR 24 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 599 - protein, 117 aa, Homo sapiens
  TCR 24 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTP

SEQ ID NO: 600 - protein, 14 aa, Homo sapiens
  TCR 24 Alpha CDR3
AMREGRGDSWGKLQ

SEQ ID NO: 601 - protein, 293 aa, Homo sapiens
  TCR 24 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 602 - protein, 293 aa, Homo sapiens
  TCR 24 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 603 - protein, 312 aa, Homo sapiens
  TCR 24 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 604 - protein, 312 aa, Homo sapiens
  TCR 24 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 605 - protein, 114 aa, Homo sapiens
  TCR 24 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVT

SEQ ID NO: 606 - protein, 13 aa, Homo sapiens
  TCR 24 Beta CDR3
ASSPFGRGSYEQY

SEQ ID NO: 607 - protein, 259 aa, Homo sapiens
  TCR 25 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVELNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 608 - protein, 259 aa, Homo sapiens
  TCR 25 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 609 - protein, 259 aa, Homo sapiens; identical to SEQ ID NO: 608
  TCR 25 - Alpha Cysteine-modified

SEQ ID NO: 610 - protein, 279 aa, Homo sapiens
  TCR 25 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 611 - protein, 118 aa, Homo sapiens
  TCR 25 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVEL

SEQ ID NO: 612 - protein, 15 aa, Homo sapiens
  TCR 25 Alpha CDR3
AMREGSLTGGGNKLT

SEQ ID NO: 613 - protein, 291 aa, Homo sapiens
  TCR 25 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 614 - protein, 291 aa, Homo sapiens
  TCR 25 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 615 - protein, 310 aa, Homo sapiens
  TCR 25 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 616 - protein, 310 aa, Homo sapiens
  TCR 25 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 617 - protein, 114 aa, Homo sapiens
  TCR 25 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSIL

SEQ ID NO: 618 - protein, 13 aa, Homo sapiens
  TCR 25 Beta CDR3
ASSLWGQSNQPQH

SEQ ID NO: 619 - protein, 255 aa, Homo sapiens
  TCR 26 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 620 - protein, 255 aa, Homo sapiens
  TCR 26 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 621 - protein, 275 aa, Homo sapiens
  TCR 26 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 622 - protein, 275 aa, Homo sapiens
  TCR 26 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 623 - protein, 114 aa, Homo sapiens
  TCR 26 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKP

SEQ ID NO: 624 - protein, 11 aa, Homo sapiens
  TCR 26 Alpha CDR3
AMRDARNNDMR

SEQ ID NO: 625 - protein, 294 aa, Homo sapiens
  TCR 26 - Beta Native
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 626 - protein, 294 aa, Homo sapiens
  TCR 26 - Beta Cysteine-modified
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 627 - protein, 313 aa, Homo sapiens
  TCR 26 - Beta Native
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 628 - protein, 313 aa, Homo sapiens
  TCR 26 - Beta Cysteine-modified
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 629 - protein, 114 aa, Homo sapiens
  TCR 26 Beta variable region
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTV

SEQ ID NO: 630 - protein, 14 aa, Homo sapiens
  TCR 26 Beta CDR3
ASSYYASGRNYEQY

SEQ ID NO: 631 - protein, 180 aa, Homo sapiens
  TCR 26 - Native TCR beta constant region
TEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 632 - protein, 180 aa, Homo sapiens
  TCR 26 -  TCR beta constant region
TEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 633 - protein, 255 aa, Homo sapiens
  TCR 27 - Alpha Native
DAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 634 - protein, 255 aa, Homo sapiens
  TCR 27 - Alpha Cysteine-modified
DAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 635 - protein, 272 aa, Homo sapiens
  TCR 27 - Alpha Native
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 636 - protein, 272 aa, Homo sapiens
  TCR 27 - Alpha Cysteine-modified
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 637 - protein, 114 aa, Homo sapiens
  TCR 27 Alpha variable region
DAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIP

SEQ ID NO: 638 - protein, 15 aa, Homo sapiens
  TCR 27 Alpha CDR3
ILRVPPQSGGYQKVT

SEQ ID NO: 639 - protein, 291 aa, Homo sapiens
  TCR 27 - Beta Native
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 640 - protein, 291 aa, Homo sapiens
  TCR 27 - Beta Cysteine-modified
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 641 - protein, 324 aa, Homo sapiens
  TCR 27 - Beta Native
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 642 - protein, 324 aa, Homo sapiens
  TCR 27 - Beta Cysteine-modified
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 643 - protein, 114 aa, Homo sapiens
  TCR 27 Beta variable region
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVL

SEQ ID NO: 644 - protein, 13 aa, Homo sapiens
  TCR 27 Beta CDR3
ASSEFGSLNEKLF

SEQ ID NO: 645 - protein, 253 aa, Homo sapiens
  TCR 28 - Alpha Native
RKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 646 - protein, 253 aa, Homo sapiens
  TCR 28 - Alpha Cysteine-modified
RKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 647 - protein, 275 aa, Homo sapiens
  TCR 28 - Alpha Native
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 648 - protein, 275 aa, Homo sapiens
  TCR 28 - Alpha Cysteine-modified
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 649 - protein, 112 aa, Homo sapiens
  TCR 28 Alpha variable region
RKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHP

SEQ ID NO: 650 - protein, 13 aa, Homo sapiens
  TCR 28 Alpha CDR3
VVRGGGTSYGKLT

SEQ ID NO: 651 - protein, 292 aa, Homo sapiens
  TCR 28 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 652 - protein, 292 aa, Homo sapiens
  TCR 28 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 653 - protein, 311 aa, Homo sapiens
  TCR 28 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 654 - protein, 311 aa, Homo sapiens
  TCR 28 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 655 - protein, 115 aa, Homo sapiens
  TCR 28 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVV

SEQ ID NO: 656 - protein, 14 aa, Homo sapiens
  TCR 28 Beta CDR3
ASSLWGRSSGNTIY

SEQ ID NO: 657 - protein, 257 aa, Homo sapiens
  TCR 29 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 658 - protein, 257 aa, Homo sapiens
  TCR 29 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 659 - protein, 277 aa, Homo sapiens
  TCR 29 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 660 - protein, 277 aa, Homo sapiens
  TCR 29 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 661 - protein, 116 aa, Homo sapiens
  TCR 29 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTL

SEQ ID NO: 662 - protein, 13 aa, Homo sapiens
  TCR 29 Alpha CDR3
AMRLNTGTASKLT

SEQ ID NO: 663 - protein, 293 aa, Homo sapiens
  TCR 29 - Beta Native
DGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 664 - protein, 293 aa, Homo sapiens
  TCR 29 - Beta Cysteine-modified
DGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 665 - protein, 312 aa, Homo sapiens
  TCR 29 - Beta Native
MSNQVLCCVVLCLLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 666 - protein, 312 aa, Homo sapiens
  TCR 29 - Beta Cysteine-modified
MSNQVLCCVVLCLLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 667 - protein, 114 aa, Homo sapiens
  TCR 29 Beta variable region
DGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVL

SEQ ID NO: 668 - protein, 5 aa, Homo sapiens
  TCR 29 Beta CDR1
LNHDA

SEQ ID NO: 669 - protein, 6 aa, Homo sapiens
  TCR 29 Beta CDR2
SQIVND

SEQ ID NO: 670 - protein, 13 aa, Homo sapiens
  TCR 29 Beta CDR3
ASSPWGRATNEQF

SEQ ID NO: 671 - protein, 19 aa, Homo sapiens
  TCR 29 Beta signal peptide
MSNQVLCCVVLCLLGANTV

SEQ ID NO: 672 - protein, 255 aa, Homo sapiens
  TCR 30 - Alpha Native
DAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 673 - protein, 255 aa, Homo sapiens
  TCR 30 - Alpha Cysteine-modified
DAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 674 - protein, 272 aa, Homo sapiens
  TCR 30 - Alpha Native
MRLVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 675 - protein, 272 aa, Homo sapiens
  TCR 30 - Alpha Cysteine-modified
MRLVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 676 - protein, 114 aa, Homo sapiens
  TCR 30 Alpha variable region
DAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIP

SEQ ID NO: 677 - protein, 7 aa, Homo sapiens
  TCR 30 Alpha CDR1
TISGNEY

SEQ ID NO: 678 - protein, 5 aa, Homo sapiens
  TCR 30 Alpha CDR2
GLKNN

SEQ ID NO: 679 - protein, 15 aa, Homo sapiens
  TCR 30 Alpha CDR3
IVRGTSVLQGNEKLT

SEQ ID NO: 680 - protein, 17 aa, Homo sapiens
  TCR 30 Alpha signal peptide
MRLVARVTVFLTFGTII

SEQ ID NO: 681 - protein, 292 aa, Homo sapiens
  TCR 30 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 682 - protein, 292 aa, Homo sapiens
  TCR 30 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 683 - protein, 311 aa, Homo sapiens
  TCR 30 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 684 - protein, 311 aa, Homo sapiens
  TCR 30 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 685 - protein, 115 aa, Homo sapiens
  TCR 30 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVV

SEQ ID NO: 686 - protein, 13 aa, Homo sapiens
  TCR 30 Beta CDR3
ASSRQPSSGNTIY

SEQ ID NO: 687 - protein, 253 aa, Homo sapiens
  TCR 31 - Alpha Native
DQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 688 - protein, 253 aa, Homo sapiens
  TCR 31 - Alpha Cysteine-modified
DQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 689 - protein, 279 aa, Homo sapiens
  TCR 31 - Alpha Native
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 690 - protein, 279 aa, Homo sapiens
  TCR 31 - Alpha Cysteine-modified
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 691 - protein, 112 aa, Homo sapiens
  TCR 31 Alpha variable region
DQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLA

SEQ ID NO: 692 - protein, 6 aa, Homo sapiens
  TCR 31 Alpha CDR1
NSMFDY

SEQ ID NO: 693 - protein, 7 aa, Homo sapiens
  TCR 31 Alpha CDR2
ISSIKDK

SEQ ID NO: 694 - protein, 11 aa, Homo sapiens
  TCR 31 Alpha CDR3
AASERGTYKYI

SEQ ID NO: 695 - protein, 26 aa, Homo sapiens
  TCR 31 Alpha signal peptide
MAMLLGASVLILWLQPDWVNSQQKND

SEQ ID NO: 696 - protein, 294 aa, Homo sapiens
  TCR 31 - Beta Native
GAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 697 - protein, 294 aa, Homo sapiens
  TCR 31 - Beta Cysteine-modified
GAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 698 - protein, 313 aa, Homo sapiens
  TCR 31 - Beta Native
MGTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 699 - protein, 313 aa, Homo sapiens
  TCR 31 - Beta Cysteine-modified
MGTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 700 - protein, 115 aa, Homo sapiens
  TCR 31 Beta variable region
GAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVL

SEQ ID NO: 701 - protein, 5 aa, Homo sapiens
  TCR 31/ TCR 45/ TCR 46 Beta CDR1
SGHTA

SEQ ID NO: 702 - protein, 6 aa, Homo sapiens
  TCR 31/ TCR 45 Beta CDR2
FQGNSA

SEQ ID NO: 703 - protein, 13 aa, Homo sapiens
  TCR 31 Beta CDR3
ASSRFLGSTDTQY

SEQ ID NO: 704 - protein, 19 aa, Homo sapiens
  TCR 31/ TCR 32 Beta signal peptide
MGTRLLFWVAFCLLGADHT

SEQ ID NO: 705 - protein, 250 aa, Homo sapiens
  TCR 32 - Alpha Native
TQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 706 - protein, 250 aa, Homo sapiens
  TCR 32 - Alpha Cysteine-modified
TQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 707 - protein, 268 aa, Homo sapiens
  TCR 32 - Alpha Native
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 708 - protein, 268 aa, Homo sapiens
  TCR 32 - Alpha Cysteine-modified
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 709 - protein, 109 aa, Homo sapiens
  TCR 32 Alpha variable region
TQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNP

SEQ ID NO: 710 - protein, 5 aa, Homo sapiens
  TCR 32/ TCR 52 Alpha CDR1
SVFSS

SEQ ID NO: 711 - protein, 7 aa, Homo sapiens
  TCR 32/ TCR 52 Alpha CDR2
VVTGGEV

SEQ ID NO: 712 - protein, 9 aa, Homo sapiens
  TCR 32 Alpha CDR3
AGGSNYKLT

SEQ ID NO: 713 - protein, 18 aa, Homo sapiens
  TCR 32/ TCR 52 Alpha signal peptide
MVLKFSVSILWIQLAWVS

SEQ ID NO: 714 - protein, 293 aa, Homo sapiens
  TCR 32 - Beta Native
DSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 715 - protein, 293 aa, Homo sapiens
  TCR 32 - Beta Cysteine-modified
DSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 716 - protein, 312 aa, Homo sapiens
  TCR 32 - Beta Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 717 - protein, 312 aa, Homo sapiens
  TCR 32 - Beta Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 718 - protein, 114 aa, Homoe sapiens
  TCR 32 Beta variable region
DSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVL

SEQ ID NO: 719 - protein, 5 aa, Homo sapiens
  TCR 32/ TCR 35/ TCR 44/ TCR 50/ TCR 52 Beta CDR1
SGDLS

SEQ ID NO: 720 - protein, 6 aa, Homo sapiens
  TCR 32/ TCR 35/ TCR 44/ TCR 50/ TCR 52  Beta CDR2
YYNGEE

SEQ ID NO: 721 - protein, 13 aa, Homo sapiens
  TCR 32 Beta CDR3
ASSVGGDHSDEQF

SEQ ID NO: 722 - protein, 254 aa, Homo sapiens
  TCR 33 - Alpha Native
QKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 723 - protein, 254 aa, Homo sapiens
  TCR 33 - Alpha Cysteine-modified
QKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 724 - protein, 276 aa, Homo sapiens
  TCR 33 - Alpha Native
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 725 - protein, 276 aa, Homo sapiens
  TCR 33 - Alpha Cysteine-modified
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 726 - protein, 113 aa, Homo sapiens
  TCR 33 Alpha variable region
QKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKA

SEQ ID NO: 727 - protein, 6 aa, Homo sapiens
  TCR 33/ TCR 43/ TCR 47/ TCR 49/ TCR 51 Alpha CDR1
DRGSQS

SEQ ID NO: 728 - protein, 6 aa, Homo sapiens
  TCR 33/ TCR 43/ TCR 47/ TCR 49/ TCR 51 Alpha CDR2
IYSNGD

SEQ ID NO: 729 - protein, 13 aa, Homo sapiens
  TCR 33 Alpha CDR3
AVNAHHTGGFKTI

SEQ ID NO: 730 - protein, 22 aa, Homo sapiens
  TCR 33/ TCR 43/ TCR 47/ TCR 48/ TCR 49/ TCR 51 Alpha signal peptide
MMKSLRVLLVILWLQLSWVWSQ

SEQ ID NO: 731 - protein, 292 aa, Homo sapiens
  TCR 33 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 732 - protein, 292 aa, Homo sapiens
  TCR 33 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 733 - protein, 311 aa, Homo sapiens
  TCR 33 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 734 - protein, 311 aa, Homo sapiens
  TCR 33 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 735 - protein, 113 aa, Homo sapiens
  TCR 33 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVT

SEQ ID NO: 736 - protein, 11 aa, Homo sapiens
  TCR 33 Beta CDR3
ASTPRDTYEQY

SEQ ID NO: 737 - protein, 250 aa, Homo sapiens
  TCR 34 - Alpha Native
ELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 738 - protein, 250 aa, Homo sapiens
  TCR 34 - Alpha Cysteine-modified
ELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 739 - protein, 268 aa, Homo sapiens
  TCR 34 - Alpha Native
MKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 740 - protein, 268 aa, Homo sapiens
  TCR 34 - Alpha Cysteine-modified
MKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 741 - protein, 109 aa, Homo sapiens
  TCR 34 Alpha variable region
ELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLA

SEQ ID NO: 742 - protein, 5 aa, Homo sapiens
  TCR 34/ TCR 37 Alpha CDR1
TTSDR

SEQ ID NO: 743 - protein, 7 aa, Homo sapiens
  TCR 34/ TCR 37 Alpha CDR2
LLSNGAV

SEQ ID NO: 744 - protein, 9 aa, Homo sapiens
  TCR 34  Alpha CDR3
AVSGTYKYI

SEQ ID NO: 745 - protein, 18 aa, Homo sapiens
  TCR 34/ TCR 37 Alpha signal peptide
MKKLLAMILWLQLDRLSG

SEQ ID NO: 746 - protein, 292 aa, Homo sapiens
  TCR 34 - Beta Native
ETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 747 - protein, 292 aa, Homo sapiens
  TCR 34 - Beta Cysteine-modified
ETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 748 - protein, 311 aa, Homo sapiens
  TCR 34 - Beta Native
MGPGLLCWALLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 749 - protein, 311 aa, Homo sapiens
  TCR 34 - Beta Cysteine-modified
MGPGLLCWALLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 750 - protein, 113 aa, Homo sapiens
  TCR 34 Beta variable region
ETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVT

SEQ ID NO: 751 - protein, 5 aa, Homo sapiens
  TCR 34/ TCR 38 Beta CDR1
SGHNT

SEQ ID NO: 752 - protein, 6 aa, Homo sapiens
  TCR 34/ TCR 38 Beta CDR2
YYREEE

SEQ ID NO: 753 - protein, 13 aa, Homo sapiens
  TCR 34 Beta CDR3
ASSSYAGSYEQYF

SEQ ID NO: 754 - protein, 19 aa, Homo sapiens
  TCR 34 Beta signal peptide
MGPGLLCWALLCLLGAGSV

SEQ ID NO: 755 - protein, 245 aa, Homo sapiens
  TCR 35 - Alpha Native
KDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 756 - protein, 245 aa, Homo sapiens
  TCR 35 - Alpha Cysteine-modified
KDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 757 - protein, 270 aa, Homo sapiens
  TCR 35 - Alpha Native
MALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 758 - protein, 270 aa, Homo sapiens
  TCR 35 - Alpha Cysteine-modified
MALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 759 - protein, 104 aa, Homo sapiens
  TCR 35 Alpha variable region
KDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRA

SEQ ID NO: 760 - protein, 6 aa, Homo sapiens
  TCR 35 Alpha CDR1
VSNAYN

SEQ ID NO: 761 - protein, 4 aa, Homo sapiens
  TCR 35 Alpha CDR2
GSKP

SEQ ID NO: 762 - protein, 9 aa, Homo sapiens
  TCR 35 Alpha CDR3
AVAGDYKLS

SEQ ID NO: 763 - protein, 25 aa, Homo sapiens
  TCR 35 Alpha signal peptide
MALQSTLGAVWLGLLLNSLWKVAES

SEQ ID NO: 764 - protein, 294 aa, Homo sapiens
  TCR 35 - Beta Native
DSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 765 - protein, 294 aa, Homo sapiens
  TCR 35 - Beta Cysteine-modified
DSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 766 - protein, 313 aa, Homo sapiens
  TCR 35 - Beta Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 767 - protein, 313 aa, Homo sapiens
  TCR 35 - Beta Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 768 - protein, 115 aa, Homo sapiens
  TCR 35 Beta variable region
DSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVL

SEQ ID NO: 769 - protein, 14 aa, Homo sapiens
  TCR 35 Beta CDR3
ASTTSGDSSYNEQF

SEQ ID NO: 770 - protein, 19 aa, Homo sapiens
  TCR 35/ TCR 44/ TCR 50/ TCR 52 Beta signal peptide
MGFRLLCCVAFCLLGAGPV

SEQ ID NO: 771 - protein, 252 aa, Homo sapiens
  TCR 36 - Alpha Native
RKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 772 - protein, 252 aa, Homo sapiens
  TCR 36 - Alpha Cysteine-modified
RKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 773 - protein, 274 aa, Homo sapiens
  TCR 36 - Alpha Native
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 774 - protein, 274 aa, Homo sapiens
  TCR 36 - Alpha Cysteine-modified
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 775 - protein, 111 aa, Homo sapiens
  TCR 36 Alpha variable region
RKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLP

SEQ ID NO: 776 - protein, 12 aa, Homo sapiens
  TCR 36 Alpha CDR3
VVNRDNYGQNFV

SEQ ID NO: 777 - protein, 292 aa, Homo sapiens
  TCR 36 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 778 - protein, 292 aa, Homo sapiens
  TCR 36 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 779 - protein, 311 aa, Homo sapiens
  TCR 36 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 780 - protein, 311 aa, Homo sapiens
  TCR 36 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 781 - protein, 113 aa, Homo sapiens
  TCR 36 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVT

SEQ ID NO: 782 - protein, 11 aa, Homo sapiens
  TCR 36 Beta CDR3
AMTGRSNYEQY

SEQ ID NO: 783 - protein, 253 aa, Homo sapiens
  TCR 37 - Alpha Native
ELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 784 - protein, 253 aa, Homo sapiens
  TCR 37 - Alpha Cysteine-modified
ELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 785 - protein, 271 aa, Homo sapiens
  TCR 37 - Alpha Native
MKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 786 - protein, 271 aa, Homo sapiens
  TCR 37 - Alpha Cysteine-modified
MKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 787 - protein, 112 aa, Homo sapiens
  TCR 37 Alpha variable region
ELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIP

SEQ ID NO: 788 - protein, 12 aa, Homo sapiens
  TCR 37 Alpha CDR3
AGYSGAGSYQLT

SEQ ID NO: 789 - protein, 291 aa, Homo sapiens
  TCR 37 - Beta Native
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 790 - protein, 291 aa, Homo sapiens
  TCR 37 - Beta Cysteine-modified
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 791 - protein, 310 aa, Homo sapiens
  TCR 37 - Beta Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 792 - protein, 310 aa, Homo sapiens
  TCR 37 - Beta Cysteine-modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 793 - protein, 114 aa, Homo sapiens
  TCR 37 Beta variable region
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVV

SEQ ID NO: 794 - protein, 12 aa, Homo sapiens
  TCR 37 Beta CDR3
ASSLLLGAYGYT

SEQ ID NO: 795 - protein, 247 aa, Homo sapiens
  TCR 38 - Alpha Native
GIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 796 - protein, 247 aa, Homo sapiens
  TCR 38 - Alpha Cysteine-modified
GIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 797 - protein, 279 aa, Homo sapiens
  TCR 38 - Alpha Native
MVKMPGARRQSIMKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 798 - protein, 279 aa, Homo sapiens
  TCR 38 - Alpha Cysteine-modified
MVKMPGARRQSIMKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 799 - protein, 106 aa, Homo sapiens
  TCR 38 Alpha variable region
GIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKP

SEQ ID NO: 800 - protein, 5 aa, Homo sapiens
  TCR 38 Alpha CDR1
DSVNN

SEQ ID NO: 801 - protein, 5 aa, Homo sapiens
  TCR 38 Alpha CDR2
IPSGT

SEQ ID NO: 802 - protein, 8 aa, Homo sapiens
  TCR 38 Alpha CDR3
AVGFNDMR

SEQ ID NO: 803 - protein, 32 aa, Homo sapiens
  TCR 38 Alpha signal peptide
MVKMPGARRQSIMKRILGALLGLLSAQVCCVR

SEQ ID NO: 804 - protein, 292 aa, Homo sapiens
  TCR 38 - Beta Native
ETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 805 - protein, 292 aa, Homo sapiens
  TCR 38 - Beta Cysteine-modified
ETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 806 - protein, 311 aa, Homo sapiens
  TCR 38 - Beta Native
MGPGLLCWVLLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 807 - protein, 311 aa, Homo sapiens
  TCR 38 - Beta Cysteine-modified
MGPGLLCWVLLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 808 - protein, 113 aa, Homo sapiens
  TCR 38 Beta variable region
ETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVL

SEQ ID NO: 809 - protein, 12 aa, Homo sapiens
  TCR 38 Beta CDR3
ASSLVAGGETQY

SEQ ID NO: 810 - protein, 19 aa, Homo sapiens
  TCR 38 Beta signal peptide
MGPGLLCWVLLCLLGAGSV

SEQ ID NO: 811 - protein, 253 aa, Homo sapiens
  TCR 39 - Alpha Native
GQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 812 - protein, 253 aa, Homo sapiens
  TCR 39 - Alpha Cysteine-modified
GQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 813 - protein, 260 aa, Homo sapiens
  TCR 39 - Alpha Native
MQLTWVSGQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 814 - protein, 260 aa, Homo sapiens
  TCR 39 - Alpha Cysteine-modified
MQLTWVSGQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 815 - protein, 112 aa, Homo sapiens
  TCR 39 Alpha variable region
GQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRA

SEQ ID NO: 816 - protein, 5 aa, Homo sapiens
  TCR 39/ TCR 40/ TCR 42/ TCR 45 Alpha CDR1
TTLSN

SEQ ID NO: 817 - protein, 7 aa, Homo sapiens
  TCR 39 Alpha CDR2
LYKAGEL

SEQ ID NO: 818 - protein, 12 aa, Homo sapiens
  TCR 39 Alpha CDR3
AGYSSSNDYKLS

SEQ ID NO: 819 - protein, 7 aa, Homo sapiens
  TCR 39 Alpha signal peptide
MQLTWVS

SEQ ID NO: 820 - protein, 291 aa, Homo sapiens
  TCR 39 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 821 - protein, 291 aa, Homo sapiens
  TCR 39 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 822 - protein, 310 aa, Homo sapiens
  TCR 39 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 823 - protein, 310 aa, Homo sapiens
  TCR 39 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 824 - protein, 114 aa, Homo sapiens
  TCR 39 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVV

SEQ ID NO: 825 - protein, 12 aa, Homo sapiens
  TCR 39 Beta CDR3
ASTPRDRGKEAF

SEQ ID NO: 826 - protein, 251 aa, Homo sapiens
  TCR 40 - Alpha Native
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 827 - protein, 251 aa, Homo sapiens
  TCR 40 - Alpha Cysteine-modified
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 828 - protein, 305 aa, Homo sapiens
  TCR 40 - Alpha Native
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 829 - protein, 305 aa, Homo sapiens
  TCR 40 - Alpha Cysteine-modified
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 830 - protein, 110 aa, Homo sapiens
  TCR 40 Alpha variable region
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKP

SEQ ID NO: 831 - protein, 7 aa, Homo sapiens
  TCR 40/ TCR 42  Alpha CDR2
LVKSGEV

SEQ ID NO: 832 - protein, 10 aa, Homo sapiens
  TCR 40 Alpha CDR3
AGRNNFNKFY

SEQ ID NO: 833 - protein, 137 aa, Mus musculus
  Transmembrane-modified/cysteine modified mouse constant alpha
NIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 834 - protein, 54 aa, Homo sapiens
  TCR 40/ TCR 42/ TCR 45 Alpha signal peptide
MHTSTFQNRPQLFLLIWKKLVPGNPFRRSWMKREREMLLITSMLVLWMQLSQVN

SEQ ID NO: 835 - protein, 292 aa, Homo sapiens
  TCR 40 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 836 - protein, 292 aa, Homo sapiens
  TCR 40 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 837 - protein, 311 aa, Homo sapiens
  TCR 40 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 838 - protein, 311 aa, Homo sapiens
  TCR 40 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 839 - protein, 113 aa, Homo sapiens
  TCR 40 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVT

SEQ ID NO: 840 - protein, 11 aa, Homo sapiens
  TCR 40 Beta CDR3
AITARSSYEQY

SEQ ID NO: 841 - protein, 253 aa, Homo sapiens
  TCR 41 - Alpha Native
RKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 842 - protein, 253 aa, Homo sapiens
  TCR 41 - Alpha Cysteine-modified
RKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 843 - protein, 275 aa, Homo sapiens
  TCR 41 - Alpha Native
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 844 - protein, 275 aa, Homo sapiens
  TCR 41 - Alpha Cysteine-modified
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 845 - protein, 112 aa, Homo sapiens
  TCR 41 Alpha variable region
RKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKA

SEQ ID NO: 846 - protein, 13 aa, Homo sapiens
  TCR 41 Alpha CDR3
VVTFALTGGFKTI

SEQ ID NO: 847 - protein, 294 aa, Homo sapiens
  TCR 41 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 848 - protein, 294 aa, Homo sapiens
  TCR 41 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 849 - protein, 313 aa, Homo sapiens
  TCR 41 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 850 - protein, 313 aa, Homo sapiens
  TCR 41 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 851 - protein, 115 aa, Homo sapiens
  TCR 41 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVT

SEQ ID NO: 852 - protein, 13 aa, Homo sapiens
  TCR 41 Beta CDR3
ASNPRDRVSYEQY

SEQ ID NO: 853 - protein, 251 aa, Homo sapiens
  TCR 42 - Alpha Native
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 854 - protein, 251 aa, Homo sapiens
  TCR 42 - Alpha Cysteine-modified
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 855 - protein, 305 aa, Homo sapiens
  TCR 42 - Alpha Native
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 856 - protein, 305 aa, Homo sapiens
  TCR 42 - Alpha Cysteine-modified
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 857 - protein, 110 aa, Homo sapiens
  TCR 42 Alpha variable region
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKP

SEQ ID NO: 858 - protein, 10 aa, Homo sapiens
  TCR 42 Alpha CDR3
AGPDNFNKFY

SEQ ID NO: 859 - protein, 292 aa, Homo sapiens
  TCR 42 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 860 - protein, 292 aa, Homo sapiens
  TCR 42 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 861 - protein, 311 aa, Homo sapiens
  TCR 42 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 862 - protein, 311 aa, Homo sapiens
  TCR 42 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 863 - protein, 113 aa, Homo sapiens
  TCR 42 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVT

SEQ ID NO: 864 - protein, 11 aa, Homo sapiens
  TCR 42 Beta CDR3
AKTSRSSYEQY

SEQ ID NO: 865 - protein, 254 aa, Homo sapiens
  TCR 43 - Alpha Native
QKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 866 - protein, 254 aa, Homo sapiens
  TCR 43 - Alpha Cysteine-modified
QKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 867 - protein, 276 aa, Homo sapiens
  TCR 43 - Alpha Native
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 868 - protein, 276 aa, Homo sapiens
  TCR 43 - Alpha Cysteine-modified
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 869 - protein, 113 aa, Homo sapiens
  TCR 43 Alpha variable region
QKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLA

SEQ ID NO: 870 - protein, 13 aa, Homo sapiens
  TCR 43 Alpha CDR3
AVNVPTSGTYKYI

SEQ ID NO: 871 - protein, 292 aa, Homo sapiens
  TCR 43 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 872 - protein, 292 aa, Homo sapiens
  TCR 43 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 873 - protein, 311 aa, Homo sapiens
  TCR 43 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 874 - protein, 311 aa, Homo sapiens
  TCR 43 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 875 - protein, 113 aa, Homo sapiens
  TCR 43 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVT

SEQ ID NO: 876 - protein, 11 aa, Homo sapiens
  TCR 43 Beta CDR3
ASTPRDSYEQY

SEQ ID NO: 877 - protein, 251 aa, Homo sapiens
  TCR 44 - Alpha Native
GQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 878 - protein, 251 aa, Homo sapiens
  TCR 44 - Alpha Cysteine-modified
GQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 879 - protein, 285 aa, Homo sapiens
  TCR 44 - Alpha Native
MAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 880 - protein, 285 aa, Homo sapiens
  TCR 44 - Alpha Cysteine-modified
MAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 881 - protein, 110 aa, Homo sapiens
  TCR 44 Alpha variable region
GQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIP

SEQ ID NO: 882 - protein, 11 aa, Homo sapiens
  TCR 44 Alpha CDR3
AQYSGGYQKVT

SEQ ID NO: 883 - protein, 290 aa, Homo sapiens
  TCR 44 - Beta Native
DSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 884 - protein, 290 aa, Homo sapiens
  TCR 44 - Beta Cysteine-modified
DSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 885 - protein, 309 aa, Homo sapiens
  TCR 44 - Beta Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 886 - protein, 309 aa, Homo sapiens
  TCR 44 - Beta Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 887 - protein, 110 aa, Homo sapiens
  TCR 44 Beta variable region
DSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTV

SEQ ID NO: 888 - protein, 10 aa, Homo sapiens
  TCR 44 Beta CDR3
ASSGTPDTQY

SEQ ID NO: 889 - protein, 180 aa, Homo sapiens
  TCR 44 Native TCR beta constant region
LEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 890 - protein, 180 aa, Homo sapiens
  TCR 44 TCR beta constant region
LEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 891 - protein, 253 aa, Homo sapiens
  TCR 45 - Alpha Native
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 892 - protein, 253 aa, Homo sapiens
  TCR 45 - Alpha Cysteine-modified
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 893 - protein, 307 aa, Homo sapiens
  TCR 45 - Alpha Native
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 894 - protein, 307 aa, Homo sapiens
  TCR 45 - Alpha Cysteine-modified
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 895 - protein, 112 aa, Homo sapiens
  TCR 45 Alpha variable region
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIP

SEQ ID NO: 896 - protein, 12 aa, Homo sapiens
  TCR 45 Alpha CDR3
AGSSGAGSYQLT

SEQ ID NO: 897 - protein, 294 aa, Homo sapiens
  TCR 45 - Beta Native
GAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 898 - protein, 294 aa, Homo sapiens
  TCR 45 - Beta Cysteine-modified
GAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 899 - protein, 313 aa, Homo sapiens
  TCR 45 - Beta Native
MGTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 900 - protein, 313 aa, Homo sapiens
  TCR 45 - Beta Cysteine-modified
MGTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 901 - protein, 115 aa, Hom sapiens
  TCR 45 Beta variable region
GAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVL

SEQ ID NO: 902 - protein, 13 aa, Homo sapiens
  TCR 45 Beta CDR3
ASSLYLGTTGELF

SEQ ID NO: 903 - protein, 19 aa, Homo sapiens
  TCR 45 Beta signal peptide
MGTRLLFWVAFCLLGAYHT

SEQ ID NO: 904 - protein, 255 aa, Homo sapiens
  TCR 46 - Alpha Native
AQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 905 - protein, 255 aa, Homo sapiens
  TCR 46 - Alpha Cysteine-modified
AQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 906 - protein, 274 aa, Homo sapiens
  TCR 46 - Alpha Native
MLLLLVPAFQVIFTLGGTRAQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 907 - protein, 274 aa, Homo sapiens
  TCR 46 - Alpha Cysteine-modified
MLLLLVPAFQVIFTLGGTRAQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 908 - protein, 114 aa, Homo sapiens
  TCR 46 Alpha variable region
AQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLA

SEQ ID NO: 909 - protein, 6 aa, Homo sapiens
  TCR 46 Alpha CDR1
SSVSVY

SEQ ID NO: 910 - protein, 8 aa, Homo sapiens
  TCR 46 Alpha CDR2
YLSGSTLV

SEQ ID NO: 911 - protein, 12 aa, Homo sapiens
  TCR 46 Alpha CDR3
AVSPSSGTYKYI

SEQ ID NO: 912 - protein, 19 aa, Homo sapiens
  TCR 46 Alpha signal peptide
MLLLLVPAFQVIFTLGGTR

SEQ ID NO: 913 - protein, 294 aa, Homo sapiens
  TCR 46 - Beta Native
GAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 914 - protein, 294 aa, Homo sapiens
  TCR 46 - Beta Cysteine-modified
GAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 915 - protein, 313 aa, Homo sapiens
  TCR 46 - Beta Native
MGTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 916 - protein, 313 aa, Homo sapiens
  TCR 46 - Beta Cysteine-modified
MGTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 917 - protein, 115 aa, Homo sapiens
  TCR 46 Beta variable region
GAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVL

SEQ ID NO: 918 - protein, 6 aa, Homo sapiens
  TCR 46 Beta CDR2
FQGTGA

SEQ ID NO: 919 - protein, 13 aa, Homo sapiens
  TCR 46 Beta CDR3
ASSLYLGGSETQY

SEQ ID NO: 920 - protein, 19 aa, Homo sapiens
  TCR 46 Beta signal peptide
MGTRLLCWAALCLLGADHT

SEQ ID NO: 921 - protein, 254 aa, Homo sapiens
  TCR 47 - Alpha Native
QKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 922 - protein, 254 aa, Homo sapiens
  TCR 47 - Alpha Cysteine-modified
QKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 923 - protein, 276 aa, Homo sapiens
  TCR 47 - Alpha Native
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 924 - protein, 276 aa, Homo sapiens
  TCR 47 - Alpha Cysteine-modified
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 925 - protein, 113 aa, Homo sapiens
  TCR 47 Alpha variable region
QKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLP

SEQ ID NO: 926 - protein, 13 aa, Homo sapiens
  TCR 47 Alpha CDR3
AVNLLSGSARQLT

SEQ ID NO: 927 - protein, 292 aa, Homo sapiens
  TCR 47 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 928 - protein, 292 aa, Homo sapiens
  TCR 47 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 929 - protein, 311 aa, Homo sapiens
  TCR 47- Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 930 - protein, 311 aa, Homo sapiens
  TCR 47 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 931 - protein, 113 aa, Homo sapiens
  TCR 47 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVT

SEQ ID NO: 932 - protein, 11 aa, Homo sapiens
  TCR 47 Beta CDR3
AMTGRTTYEQY

SEQ ID NO: 933 - protein, 252 aa, Homo sapiens
  TCR 48 - Alpha Native
QKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 934 - protein, 252 aa, Homo sapiens
  TCR 48 - Alpha Cysteine-modified
QKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 935 - protein, 274 aa, Homo sapiens
  TCR 48 - Alpha Native
MMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 936 - protein, 274 aa, Homo sapiens
  TCR 48 - Alpha Cysteine-modified
MMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 937 - protein, 111 aa, Homo sapiens
  TCR 48 Alpha variable region
QKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINP

SEQ ID NO: 938 - protein, 6 aa, Homo sapiens
  TCR 48 Alpha CDR1
NSAFQY

SEQ ID NO: 939 - protein, 6 aa, Homo sapiens
  TCR 48 Alpha CDR2
TYSSGN

SEQ ID NO: 940 - protein, 11 aa, Homo sapiens
  TCR 48 Alpha CDR3
AMRIQGAQKLV

SEQ ID NO: 941 - protein, 292 aa, Homo sapiens
  TCR 48 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 942 - protein, 292 aa, Homo sapiens
  TCR 48 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 943 - protein, 311 aa, Homo sapiens
  TCR 48- Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 944 - protein, 311 aa, Homo sapiens
  TCR 48 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 945 - protein, 113 aa, Homo sapiens
  TCR 48 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVT

SEQ ID NO: 946 - protein, 11 aa, Homo sapiens
  TCR 48 Beta CDR3
ASTGRVSYEQY

SEQ ID NO: 947 - protein, 254 aa, Homo sapiens
  TCR 49 - Alpha Native
QKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 948 - protein, 254 aa, Homo sapiens
  TCR 49 - Alpha Cysteine-modified
QKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 949 - protein, 276 aa, Homo sapiens
  TCR 49 - Alpha Native
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 950 - protein, 276 aa, Homo sapiens
  TCR 49 - Alpha Cysteine-modified
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 951 - protein, 113 aa, Homo sapiens
  TCR 49 Alpha variable region
QKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLA

SEQ ID NO: 952 - protein, 13 aa, Homo sapiens
  TCR 49 Alpha CDR3
AVNIGTSGTYKYI

SEQ ID NO: 953 - protein, 292 aa, Homo sapiens
  TCR 49 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 954 - protein, 292 aa, Homo sapiens
  TCR 49 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 955 - protein, 311 aa, Homo sapiens
  TCR 49- Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 956 - protein, 311 aa, Homo sapiens
  TCR 49 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 957 - protein, 113 aa, Homo sapiens
  TCR 49 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVT

SEQ ID NO: 958 - protein, 11 aa, Homo sapiens
  TCR 49 Beta CDR3
ASTPRYSYEQY

SEQ ID NO: 959 - protein, 252 aa, Homo sapiens
  TCR 50 - Alpha Native
GEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 960 - protein, 252 aa, Homo sapiens
  TCR 50 - Alpha Cysteine-modified
GEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 961 - protein, 273 aa, Homo sapiens
  TCR 50 - Alpha Native
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 962 - protein, 273 aa, Homo sapiens
  TCR 50 - Alpha Cysteine-modified
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 963 - protein, 111 aa, Homo sapiens
  TCR 50 Alpha variable region
GEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLA

SEQ ID NO: 964 - protein, 11 aa, Homo sapiens
  TCR 50 Alpha CDR3
AESPPGTYKYI

SEQ ID NO: 965 - protein, 290 aa, Homo sapiens
  TCR 50 - Beta Native
DSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 966 - protein, 290 aa, Homo sapiens
  TCR 50 - Beta Cysteine-modified
DSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 967 - protein, 309 aa, Homo sapiens
  TCR 50- Beta Native
MGFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 968 - protein, 309 aa, Homo sapiens
  TCR 50 - Beta Cysteine-modified
MGFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 969 - protein, 113 aa, Homo sapiens
  TCR 50 Beta variable region
DSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVV

SEQ ID NO: 970 - protein, 12 aa, Homo sapiens
  TCR 50 Beta CDR3
ASSATRDAYGYT

SEQ ID NO: 971 - protein, 255 aa, Homo sapiens
  TCR 51 - Alpha Native
QKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 972 - protein, 255 aa, Homo sapiens
  TCR 51 - Alpha Cysteine-modified
QKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 973 - protein, 277 aa, Homo sapiens
  TCR 51 - Alpha Native
MMKSLRVLLVILWLQLSWVWSQQKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 974 - protein, 277 aa, Homo sapiens
  TCR 51 - Alpha Cysteine-modified
MMKSLRVLLVILWLQLSWVWSQQKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 975 - protein, 114 aa, Homo sapiens
  TCR 51 Alpha variable region
QKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNP

SEQ ID NO: 976 - protein, 14 aa, Homo sapiens
  TCR 51 Alpha CDR3
AVNMRGGGSNYKLT

SEQ ID NO: 977 - protein, 292 aa, Homo sapiens
  TCR 51 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 978 - protein, 292 aa, Homo sapiens
  TCR 51 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 979 - protein, 311 aa, Homo sapiens
  TCR 51- Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 980 - protein, 311 aa, Homo sapiens
  TCR 51 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 981 - protein, 113 aa, Homo sapiens
  TCR 51 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVT

SEQ ID NO: 982 - protein, 11 aa, Homo sapiens
  TCR 51 Beta CDR3
AIASRVSYEQY

SEQ ID NO: 983 - protein, 250 aa, Homo sapiens
  TCR 52 - Alpha Native
TQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 984 - protein, 250 aa, Homo sapiens
  TCR 52 - Alpha Cysteine-modified
TQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 985 - protein, 268 aa, Homo sapiens
  TCR 52 - Alpha Native
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 986 - protein, 268 aa, Homo sapiens
  TCR 52 - Alpha Cysteine-modified
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 987 - protein, 109 aa, Homo sapiens
  TCR 52 Alpha variable region
TQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRA

SEQ ID NO: 988 - protein, 9 aa, Homo sapiens
  TCR 52 Alpha CDR3
AGARDYKLS

SEQ ID NO: 989 - protein, 292 aa, Homo sapiens
  TCR 52 - Beta Native
DSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 990 - protein, 292 aa, Homo sapiens
  TCR 52 - Beta Cysteine-modified
DSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 991 - protein, 311 aa, Homo sapiens
  TCR 52- Beta Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 992 - protein, 311 aa, Homo sapiens
  TCR 52 - Beta Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 993 - protein, 113 aa, Homo sapiens
  TCR 52 Beta variable region
DSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVL

SEQ ID NO: 994 - protein, 12 aa, Homo sapiens
  TCR 52 Beta CDR3
ASSVGDLNNEQF

SEQ ID NO: 995 - protein, 256 aa, Homo sapiens
  TCR 53 - Alpha Native
AQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 996 - protein, 256 aa, Homo sapiens
  TCR 53 - Alpha Cysteine-modified
AQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 997 - protein, 275 aa, Homo sapiens
  TCR 53 - Alpha Native
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 998 - protein, 275 aa, Homo sapiens
  TCR 53 - Alpha Cysteine-modified
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 999 - protein, 115 aa, Homo sapiens
  TCR 53 Alpha variable region
AQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLA

SEQ ID NO: 1000 - protein, 6 aa, Homo sapiens
  TCR 53 Alpha CDR1
VSGNPY

SEQ ID NO: 1001 - protein, 8 aa, Homo sapiens
  TCR 53 Alpha CDR2
YITGDNLV

SEQ ID NO: 1002 - protein, 13 aa, Homo sapiens
  TCR 53 Alpha CDR3
AVRDFGSGTYKYI

SEQ ID NO: 1003 - protein, 19 aa, Homo sapiens
  TCR 53 Alpha CDR3
MASAPISMLAMLFTLSGLR

SEQ ID NO: 1004 - protein, 295 aa, Homo sapiens
  TCR 53 - Beta Native
GAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1005 - protein, 295 aa, Homo sapiens
  TCR 53 - Beta Cysteine-modified
GAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1006 - protein, 314 aa, Homo sapiens
  TCR 53- Beta Native
MGTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1007 - protein, 314 aa, Homo sapiens
  TCR 53 - Beta Cysteine-modified
MGTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1008 - protein, 116 aa, Homo sapiens
  TCR 53 Beta variable region
GAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVL

SEQ ID NO: 1009 - protein, 6 aa, Homo sapiens
  TCR 53 Beta CDR2
FNYEAQ

SEQ ID NO: 1010 - protein, 14 aa, Homo sapiens
  TCR 53 Beta CDR3
ASSGSGTSGYNEQF

SEQ ID NO: 1011 - protein, 19 aa, Homo sapiens
  TCR 53 Beta signal peptide
MGTSLLCWVVLGFLGTDHT

SEQ ID NO: 1012 - protein, 136 aa, Mus musculus
  Mouse alpha constant
IQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 1013 - protein, 173 aa, Mus musculus
  Mouse beta constant
EDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 1014 - protein, 137 aa, Mus musculus; identical to SEQ ID NO: 317
  Mouse alpha constant

SEQ ID NO: 1015 - protein, 137 aa, Mus musculus
  Mouse alpha constant
  VARIANT (48)...(48): X = unknown or other
  VARIANT (112)...(112): X = unknown or other
  VARIANT (114)...(114): X = unknown or other
  VARIANT (115)...(115): X = unknown or other
NIQNPEPAVYQLKDPRSQDSTLCLFTDFDSQINVPKTMESGTFITDKXVLDMKAMDSKSNGAIAWSNQTSFTCQDIFKETNATYPSSDVPCDATLTEKSFETDMNLNFQNLXVXXLRILLLKVAGFNLLMTLRLWSS

SEQ ID NO: 1016 - protein, 173 aa, Mus musculus
  Mouse beta constant
  VARIANT (57)...(57): X = unknown or other
EDLRNVTPPKVSLFEPSKAEIANKQKATLVCLARGFFPDHVELSWWVNGKEVHSGVXTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 1017 - protein, 137 aa, Mus musculus
  Mouse alpha constant Cysteine-substituted
NIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLSVMGLRILLLKVAGFNLLMTLRLWSS

SEQ ID NO: 1018 - protein, 137 aa, Mus musculus
  Mouse alpha constant Transmembrane modified
NIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 1019 - DNA, 498 bp, Homo sapiens
  TCR 17 - Alpha  Native
gagtaattcttctctcaccatgccaggttcacttcacagtacagagtcctgaaaataaagaagaaaatttttttttatctagaaaaagaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatccaagttatggtctattctggtacaagcagcccagcagtggggaaatgatttttcttatttatcaggggtcttatgaccagcaaaatgcaacagaaggtcgctactcattgaatttccagaaggcaagaaaatccgccaaccttgtcatctccgcttcacaactgggggactcagcaatgtacttctgtgcaatgagagagggccggggtgacaagatcatctttggaaaagggacacgacttcatattctcccc

SEQ ID NO: 1020 - DNA, 420 bp, Homo sapiens; identical to SEQ ID NO: 431
  TCR 17 - Beta Native

SEQ ID NO: 1021 - DNA, 481 bp, Homo sapiens
  TCR 18 - Alpha Native
agagtgtttatcttgtgagccattctccatatttcagatataagatttcagttctcagtgagtctaagtgacagaaggaatggagaccctcttgggcctgcttatcctttggctgcagctgcaatgggtgagcagcaaacaggaggtgacgcagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgaggggaatgctggtggtactagctatggaaagctgacatttggacaagggaccatcttgactgtccatcca

SEQ ID NO: 1022 - DNA, 420 bp, Homo sapiens
  TCR 18 - Beta Native
gattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttttgggggcgatctaattcacccctccactttgggaacgggaccaggctcactgtgaca

SEQ ID NO: 1023 - DNA, 501 bp, Homo sapiens
  TCR 19 - Alpha Native
gaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagagaataccggcactgccagtaaactcacctttgggactggaacaagacttcaggtcacgctc

SEQ ID NO: 1024 - DNA, 420 bp, Homo sapiens
  TCR 19 - Beta Native
gattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagttcttggggacaaagcacaggcgagcagtacttcgggccgggcaccaggctcacggtcaca

SEQ ID NO: 1025 - DNA, 516 bp, Homo sapiens
  TCR 20 - Alpha Native
gagaagcctcacacagcccagtaactttgctagtacctcttgagtgcaaggtggagaattaagatctggatttgagacggagcacggaacatttcactcaggggaagagctatgaacatgctgactgccagcctgttgagggcagtcatagcctccatctgtgttgtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgtggactggggcaaacaacctcttctttgggactggaacgagactcaccgttattccc

SEQ ID NO: 1026 - DNA, 436 bp, Homo sapiens
  TCR 20  - Beta Native
gacaactctccccagagaaggtggtgtgaggccatcacggaagatgctgctgcttctgctgcttctggggccaggctccgggcttggtgctgtcgtctctcaacatccgagcagggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagctcgttggcccgtcgctcctacgagcagtacttcgggccgggcaccaggctcacggtcaca

SEQ ID NO: 1027 - DNA, 510 bp, Homo sapiens
  TCR 21 - Alpha Native
gagtaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagagggccgggtcacgggaggaggaaacaaactcacctttgggacaggcactcagctaaaagtggaactc

SEQ ID NO: 1028 - DNA, 480 bp, Homo sapiens
  TCR 21 - Beta Native
gagaatgacccccttgagagtactgttcccctatcaccgatgcacagacccagaagacccctccatcctgtagcacctgccatgagcatcgggctcctgtgctgtgtggccttttctctcctgtgggcaagtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcaggccctgggggaaccagaacactgaagctttctttggacaaggcaccagactcacagttgta

SEQ ID NO: 1029 - DNA, 468 bp, Homo sapiens
  TCR 22 - Alpha Native
acatgaagtgtctaccttctgcagactccaatggctcaggaactgggaatgcagtgccaggctcgtggtatcctgcagcagatgtggggagttttccttctttatgtttccatgaagatgggaggcactacaggacaaaacattgaccagcccactgagatgacagctacggaaggtgccattgtccagatcaactgcacgtaccagacatctgggttcaacgggctgttctggtaccagcaacatgctggcgaagcacccacatttctgtcttacaatgttctggatggtttggaggagaaaggtcgtttttcttcattccttagtcggtctaaagggtacagttacctccttttgaaggagctccagatgaaagactctgcctcttacctctgtgctgtgcgcgcacgtatggatagcaactatcagttaatctggggcgctgggaccaagctaattataaagcca

SEQ ID NO: 1030 - DNA, 444 bp, Homo sapiens
  TCR 22 - Beta Native
gaggaggaccaagccctgaatcaggtgcagtgctgcctgccccactgtgccatgggccctgggctcctctgctgggtgctgctttgtctcctgggagcaggcccagtggacgctggagtcacccaaagtcccacacacctgatcaaaacgagaggacagcacgtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcagccgaactgaaaactatggctacaccttcggttcggggaccaggttaaccgttgta

SEQ ID NO: 1031 - DNA, 501 bp, Homo sapiens
  TCR 23 - Alpha Native
gaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagtcctccgggtggttctgcaaggcaactgacctttggatctgggacacaattgactgttttacct

SEQ ID NO: 1032 - DNA, 413 bp, Homo sapiens
  TCR  23 - Beta Native
gcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtccctggggacaaagcaatcagccccagcattttggtgatgggactcgactctccatccta

SEQ ID NO: 1033 - DNA, 504 bp, Homo sapiens
  TCR 24 - Alpha Native
gaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagagggcaggggtgacagctgggggaaattgcagtttggagcagggacccaggttgtggtcacccca

SEQ ID NO: 1034 - DNA, 420 bp, Homo sapiens
  TCR 24 - Beta Native
gattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagccccttcgggaggggctcctacgagcagtacttcgggccgggcaccaggctcacggtcaca

SEQ ID NO: 1035 - DNA, 508 bp, Homo sapiens
  TCR 25 - Alpha Native
agtaattcttctctcaccatgccaggttcacctcacagtacagagtcctgaaaataaagaagaagattttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagagggctcgctcacgggaggaggaaacaaactcacctttgggacaggcactcagctaaaagtggaactc

SEQ ID NO: 1036 - DNA, 422 bp, Homo sapiens
  TCR 25 - Beta Native
gctattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggacagagcaatcagccccagcattttggtgatgggactcgactctccatccta

SEQ ID NO: 1037 - DNA, 498 bp, Homo sapiens
  TCR 26 - Alpha Native
gagtaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagacgcccggaacaatgacatgcgctttggagcagggaccagactgacagtaaaacca

SEQ ID NO: 1038 - DNA, 437 bp, Homo sapiens
  TCR 26 - Beta Native
acagacccagaggacccctccatcctgcagttcctgccatgagcctcgggctcctgtgctgtggggccttttctctcctgtgggcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttactatgctagcgggagaaactacgagcagtacttcgggccgggcaccaggctcacggtc

SEQ ID NO: 1039 - DNA, 410 bp, Homo sapiens
  TCR 27  - Alpha Native
gaatgtgcacttgaacaatgaagttggtgacaagcattactgtactcctatctttgggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagtccccccccagtctgggggttaccagaaagttacctttggaactggaacaaagctccaagtcatccca

SEQ ID NO: 1040 - DNA, 480 bp, Homo sapiens
  TCR 27 - Beta Native
gagaatgacccccttgagagtactgttcccctatcaccgatgcacagacccagaagacccctccatcctgtagcacctgccatgagcatcgggctcctgtgctgtgtggccttttctctcctgtgggcaagtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaatttgggagcttgaatgaaaaactgttttttggcagtggaacccagctctctgtcttg

SEQ ID NO: 1041 - DNA, 513 bp, Homo sapiens
  TCR 28 - Alpha Native
aggacagattctttttatgattcctaaagtggaagaaataaagtatctctgctatgttcatttctttttggattgaaaattttaatcctcagtgaaccagggcagaaaagaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgagggggggtggtactagctatggaaagctgacatttggacaagggaccatcttgactgtccatcca

SEQ ID NO: 1042 - DNA, 427 bp, Homo sapiens
  TCR 28 - Beta Native
gacctattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagcttgtggggcaggagctctggaaacaccatatattttggagagggaagttggctcactgttgta

SEQ ID NO: 1043 - DNA, 493 bp, Homo sapiens
  TCR  29 - Alpha Native
gtctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattttggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagactaaataccggcactgccagtaaactcacctttgggactggaacaagacttcaggtcacgctc

SEQ ID NO: 1044 - DNA, 514 bp, Homo sapiens
  TCR 29 - Beta Native
attccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtctcctgggagcaaacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtccctgggggcgggcaaccaatgagcagttcttcgggccagggacacggctcaccgtgcta

SEQ ID NO: 1045 - DNA, 490 bp, Homo sapiens
  TCR 30 - Alpha Native
gagtagctgttgcttctgttctctggaaattctttaaacctagaatcagacacaaaaactgaactctgggtccacaatcctcatttgtccttgaagtatgaggctggtggcaagagtaactgtgtttctgacctttggaactataattgatgctaagaccacccagcccccctccatggattgcgctgaaggaagagctgcaaacctgccttgtaatcactctaccatcagtggaaatgagtatgtgtattggtatcgacagattcactcccaggggccacagtatatcattcatggtctaaaaaacaatgaaaccaatgaaatggcctctctgatcatcacagaagacagaaagtccagcaccttgatcctgccccacgctacgctgagagacactgctgtgtactattgcatcgtcagaggcacctctgtcttgcagggaaatgagaaattaacctttgggactggaacaagactcaccatcataccc

SEQ ID NO: 1046 - DNA, 456 bp, Homo sapiens
  TCR 30  - Beta Native
gacaggaccagatgcctgagctaggaaaggcctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtcgacagcccagctctggaaacaccatatattttggagagggaagttggctcactgttgta

SEQ ID NO: 1047 - DNA, 1489 bp, Homo sapiens
  Human TCR beta constant 2 (TRBC2)
  ref <308>: DATABASE ACCESSION NUMBER: NCBI NG_001333.2
  ref <309>: DATABASE ENTRY DATE: 2016-08-31
aggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcggacaagactagatccagaagaaagccagagtggacaaggtgggatgatcaaggttcacagggtcagcaaagcacggtgtgcacttcccccaccaagaagcatagaggctgaatggagcacctcaagctcattcttccttcagatcctgacaccttagagctaagctttcaagtctccctgaggaccagccatacagctcagcatctgagtggtgtgcatcccattctcttctggggtcctggtttcctaagatcatagtgaccacttcgctggcactggagcagcatgagggagacagaaccagggctatcaaaggaggctgactttgtactatctgatatgcatgtgtttgtggcctgtgagtctgtgatgtaaggctcaatgtccttacaaagcagcattctctcatccatttttcttcccctgttttctttcagactgtggcttcacctccggtaagtgagtctctcctttttctctctatctttcgccgtctctgctctcgaaccagggcatggagaatccacggacacaggggcgtgagggaggccagagccacctgtgcacaggtgcctacatgctctgttcttgtcaacagagtcttaccagcaaggggtcctgtctgccaccatcctctatgagatcttgctagggaaggccaccttgtatgccgtgctggtcagtgccctcgtgctgatggccatggtaaggaggagggtgggatagggcagatgatgggggcaggggatggaacatcacacatgggcataaaggaatctcagagccagagcacagcctaatatatcctatcacctcaatgaaaccataatgaagccagactggggagaaaatgcagggaatatcacagaatgcatcatgggaggatggagacaaccagcgagccctactcaaattaggcctcagagcccgcctcccctgccctactcctgctgtgccatagcccctgaaaccctgaaaatgttctctcttccacaggtcaagagaaaggattccagaggctag

SEQ ID NO: 1048 - RNA, 20 nt, Artificial Sequence
  TRAC gRNA targeting domain
gagaaucaaaaucggugaau

SEQ ID NO: 1049 - DNA, 467 bp, Homo sapiens
  TCR 32 - Alpha Native
gagcccagagaagtctgttccaggacgggctctttcaggagcagctaaagtcaggggccatgtccaccatgtgatagaaagacaagatggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggaggtagcaactataaactgacatttggaaaaggaactctcttaaccgtgaatcca

SEQ ID NO: 1050 - DNA, 447 bp, Homo sapiens
  TCR  32- Beta Native
gagaatgcttactacagagacaccagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgtagggggggatcattctgatgagcagttcttcgggccagggacacggctcaccgtgcta

SEQ ID NO: 1051 - DNA, 508 bp, Homo sapiens
  TCR 33 - Alpha Native
gaaagcagattctttttatgatttttaaagtagaaatatccattctaggtgcattttttaagggtttaaaatttgaatcctcagtgaaccagggcagagaagaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacgcgcaccatactggaggcttcaaaactatctttggagcaggaacaagactatttgttaaagca

SEQ ID NO: 1052 - DNA, 417 bp, Homo sapiens
  TCR 33  - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccccacgggacacctacgagcagtacttcgggccgggcaccaggctcacggtcaca

SEQ ID NO: 1053 - RNA, 20 nt, Artificial Sequence
  TRBC gRNA targeting domain
ggccucggcgcugacgaucu

SEQ ID NO: 1054 - DNA, 20 bp, Homo sapiens
  TRBC target sequence
agatcgtcagcgccgaggcc

SEQ ID NO: 1055 - DNA, 397 bp, Homo sapiens
  TCR 35 - Alpha Native
gattttggccatggctttgcagagcactctgggggcggtgtggctagggcttctcctcaactctctctggaaggttgcagaaagcaaggaccaagtgtttcagccttccacagtggcatcttcagagggagctgtggtggaaatcttctgtaatcactctgtgtccaatgcttacaacttcttctggtaccttcacttcccgggatgtgcaccaagactccttgttaaaggctcaaagccttctcagcagggacgatacaacatgacctatgaacggttctcttcatcgctgctcatcctccaggtgcgggaggcagatgctgctgtttactactgtgctgtggcgggcgactacaagctcagctttggagccggaaccacagtaactgtaagagca

SEQ ID NO: 1056 - DNA, 450 bp, Homo sapiens
  TCR 35 - Beta Native
gagaatgcttactacagagacaccagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagtacaactagcggggattcctcctacaatgagcagttcttcgggccagggacacggctcaccgtgcta

SEQ ID NO: 1057 - DNA, 511 bp, Homo sapiens
  TCR 36 - Alpha Native
gaggacagattctttttatgattcctaaagtggaagaaataaagtatctctgctatgttcatttctttttggattgaaaattttaatcctcagtgaaccagggcagaaaagaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaaccgggataactatggtcagaattttgtctttggtcccggaaccagattgtccgtgctgccc

SEQ ID NO: 1058 - DNA, 416 bp, Homo sapiens
  TCR 36 - Beta Native
attcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatgaccggacggagcaactacgagcagtacttcgggccgggcaccaggctcacggtcaca

SEQ ID NO: 1059 - DNA, 464 bp, Homo sapiens
  TCR 37 - Alpha Native
gatatttggatagccctggccaactttcaaggctcctaaatctgagttttcagtgaactggacagaaaaaaaaaatgaagaagctactagcaatgattctgtggcttcaactagaccggttaagtggagagctgaaagtggaacaaaaccctctgttcctgagcatgcaggagggaaaaaactataccatctactgcaattattcaaccacttcagacagactgtattggtacaggcaggatcctgggaaaagtctggaatctctgtttgtgttgctatcaaatggagcagtgaagcaggagggacgattaatggcctcacttgataccaaagcccgtctcagcaccctccacatcacagctgccgtgcatgacctctctgccacctacttctgtgccgggtactctggggctgggagttaccaactcactttcgggaaggggaccaaactctcggtcatacca

SEQ ID NO: 1060 - DNA, 447 bp, Homo sapiens
  TCR 37 - Beta Native
gacagtgacactgatctggtaaagcccccatcctggcctgaccctgccatgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcttacttctgggggcctatggctacaccttcggttcggggaccaggttaaccgttgta

SEQ ID NO: 1061 - DNA, 513 bp, Homo sapiens
  TCR 38 - Alpha Native
gaggctttgtcgggtggagctgattggttgcaggagcagcaacagttccagagccaagtcatgacaccgacctccccaaggtttagttaaatatatcttatggtgaaaatgcccggagcaagaaggcaaagcatcatgaagaggatattgggagctctgctggggctcttgagtgcccaggtttgctgtgtgagaggaatacaagtggagcagagtcctccagacctgattctccaggagggagccaattccacgctgcggtgcaatttttctgactctgtgaacaatttgcagtggtttcatcaaaacccttggggacagctcatcaacctgttttacattccctcagggacaaaacagaatggaagattaagcgccacgactgtcgctacggaacgctacagcttattgtacatttcctcttcccagaccacagactcaggcgtttatttctgtgctgtggggttcaatgacatgcgctttggagcagggaccagactgacagtaaaacca

SEQ ID NO: 1062 - DNA, 426 bp, Homo sapiens
  TCR 38 - Beta Native
gaggtgcagtgctgcctgccccactgtgccatgggccctgggctcctctgctgggtgctgctttgtctcctgggagcaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcagcttggtagcgggtggagagacccagtacttcgggccaggcacgcggctcctggtgctc

SEQ ID NO: 1063 - DNA, 371 bp, Homo sapiens
  TCR 39 - Alpha Native
gaataatcttgtggatgcagctgacatgggtcagtggtcaacagctgaatcagagtcctcaatctatgtttatccaggaaggagaagatgtctccatgaactgcacttcttcaagcatatttaacacctggctatggtacaagcaggaacctggggaaggtcctgtcctcttgatagccttatataaggctggtgaattgacctcaaatggaagactgactgctcagtttggtataaccagaaaggacagcttcctgaatatctcagcatccatacctagtgatgtaggcatctacttctgtgctggatactcatcttctaacgactacaagctcagctttggagccggaaccacagtaactgtaagagca

SEQ ID NO: 1064 - DNA, 420 bp, Homo sapiens
  TCR 39 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacccctagggacaggggcaaggaagctttctttggacaaggcaccagactcacagttgta

SEQ ID NO: 1065 - DNA, 502 bp, Homo sapiens
  TCR 40  - Alpha Native
gctttccaaaatgcacacatctactttccaaaatagaccgcaactatttctattgatctggaagaagcttgtaccaggcaacccatttaggagaagttggatgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcagggcggaacaacttcaacaaattttactttggatctgggaccaaactcaatgtaaaacca

SEQ ID NO: 1066 - DNA, 417 bp, Homo sapiens
  TCR 40 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccataacggcccggagctcctacgagcagtacttcgggccgggcaccaggctcacggtcaca

SEQ ID NO: 1067 - DNA, 451 bp, Homo sapiens
  TCR 41  - Alpha Native
gctttttggattgaaaattttaatcctcagtgaaccagggcagaaaagaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaccttcgcccttactggaggcttcaaaactatctttggagcaggaacaagactatttgttaaagca

SEQ ID NO: 1068 - DNA, 426 bp, Homo sapiens
  TCR 41  - Beta Native
gctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaatccccgggacagggtctcctacgagcagtacttcgggccgggcaccaggctcacggtcaca

SEQ ID NO: 1069 - DNA, 502 bp, Homo sapiens
  TCR  42- Alpha Native
gctttccaaaatgcacacatctactttccaaaatagaccgcaactatttctattgatctggaagaagcttgtaccaggcaacccatttaggagaagttggatgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcagggccggacaacttcaacaaattttactttggatctgggaccaaactcaatgtaaaacca

SEQ ID NO: 1070 - DNA, 417 bp, Homo sapiens
  TCR 42 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccaaaacatctcgaagctcctacgagcagtacttcgggccgggcaccaggctcacggtcaca

SEQ ID NO: 1071 - DNA, 508 bp, Homo sapiens
  TCR 43 - Alpha Native
gaaagcagattctttttatgatttttaaagtagaaatatccattccaggtgcattttttaagggtttaaaatttgaatcctcagtgaaccagggcagagaagaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgtccatatactccaatggtgacaaagaagatggaaggtttacagcacagctcaataaagccagccagtatgtttctctgctcatcagagactcccagcccagtgattcagccacctacctctgtgccgtgaacgttcccacctcaggaacctacaaatacatctttggaacaggcaccaggctgaaggttttagca

SEQ ID NO: 1072 - DNA, 420 bp, Homo sapiens
  TCR 43  - Beta Native
gctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccccccgggacagctacgagcagtacttcgggccgggcaccaggctcacggtcaca

SEQ ID NO: 1073 - DNA, 482 bp, Homo sapiens
  TCR 44 - Alpha Native
ggagtttccttccctcacccacatgaagtgtctaccttctgcagactccaatggctcaggaactgggaatgcagtgccaggctcgtggtatcctgcagcagatgtggggagttttccttctttatgtttccatgaagatgggaggcactacaggacaaaacattgaccagcccactgagatgacagctacggaaggtgccattgtccagatcaactgcacgtaccagacatctgggttcaacgggctgttctggtaccagcaacatgctggcgaagcacccacatttctgtcttacaatgttctggatggtttggaggagaaaggtcgtttttcttcattccttagtcggtctaaagggtacagttacctccttttgaaggagctccagatgaaagactctgcctcttacctctgtgcccaatattctgggggttaccagaaagttacctttggaactggaacaaagctccaagtcatccca

SEQ ID NO: 1074 - DNA, 435 bp, Homo sapiens
  TCR 44 - Beta Native
gagaatgcttactacagagacaccagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgggaccccagatacgcagtattttggcccaggcacccggctgacagtg

SEQ ID NO: 1075 - DNA, 508 bp, Homo sapiens
  TCR 45 - Alpha Native
gctttccaaaatgcacacatctactttccaaaatagaccgcaactatttctattgatctggaagaagcttgtaccaggcaacccatttaggagaagttggatgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcaggttcctctggggctgggagttaccaactcactttcgggaaggggaccaaactctcggtcatacca

SEQ ID NO: 1076 - DNA, 450 bp, Homo sapiens
  TCR 45 - Beta Native
gacagtgatcctgatctggtaaagctcccatcctgccctgaccctgccatgggcaccaggctcctcttctgggtggccttctgtctcctgggggcatatcacacaggagctggagtctcccagtcccccagtaacaaggtcacagagaagggaaaggatgtagagctcaggtgtgatccaatttcaggtcatactgccctttactggtaccgacagaggctggggcagggcctggagtttttaatttacttccaaggcaacagtgcaccagacaaatcagggctgcccagtgatcgcttctctgcagagaggactggggaatccgtctccactctgacgatccagcgcacacagcaggaggactcggccgtgtatctctgtgccagcagcctttacttggggaccaccggggagctgttttttggagaaggctctaggctgaccgtactg

SEQ ID NO: 1077 - DNA, 524 bp, Homo sapiens
  TCR 46 - Alpha Native
ggaaacttttcaaagccagggacttgtccaatccaacctcctcacagttcctagctcctgaggctcagcgcccttggcttctgtccgcccagctcaaggtcctgcagcattgccactgctcagccatgctcctgctgctcgtcccagcgttccaggtgatttttaccctgggaggaaccagagcccagtctgtgacccagcttgacagccaagtccctgtctttgaagaagcccctgtggagctgaggtgcaactactcatcgtctgtttcagtgtatctcttctggtatgtgcaataccccaaccaaggactccagcttctcctgaagtatttatcaggatccaccctggttaaaggcatcaacggttttgaggctgaatttaacaagagtcaaacttccttccacttgaggaaaccctcagtccatataagcgacacggctgagtacttctgtgctgtgagcccttcctcaggaacctacaaatacatctttggaacaggcaccaggctgaaggttttagca

SEQ ID NO: 1078 - DNA, 449 bp, Homo sapiens
  TCR 46 - Beta Native
acagtgaccctgatctggtaaagctcccatcctgccctgactctgtcatgggcaccaggctcctctgctgggcagccctgtgcctcctgggggcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagcttatatctggggggttcggagacccagtacttcgggccaggcacgcggctcctggtgctc

SEQ ID NO: 1079 - DNA, 509 bp, Homo sapiens
  TCR 47 - Alpha Native
gaaaagcagattctttttatgatttttaaagtagaaatatccattctaggtgcattttttaagggtttaaaatttgaatcctcagtgaaccagggcagagaagaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacctgctttcgggttctgcaaggcaactgacctttggatctgggacacaattgactgttttacct

SEQ ID NO: 1080 - DNA, 420 bp, Homo sapiens
  TCR 47 - Beta Native
gctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatgacagggcggactacctacgagcagtacttcgggccgggcaccaggctcacggtcaca

SEQ ID NO: 1081 - DNA, 507 bp, Homo sapiens
  TCR 48 - Alpha Native
aggacagatttcttttatgattcctacagcagaaaaatgagaaacgtttgttattatttttttttcgtgtttaaggtttgaatcctcagtgaaccagggcagaaaagaatgatgaaatccttgagagttttactggtgatcctgtggcttcagttaagctgggtttggagccaacagaaggaggtggagcaggatcctggaccactcagtgttccagagggagccattgtttctctcaactgcacttacagcaacagtgcttttcaatacttcatgtggtacagacagtattccagaaaaggccctgagttgctgatgtacacatactccagtggtaacaaagaagatggaaggtttacagcacaggtcgataaatccagcaagtatatctccttgttcatcagagactcacagcccagtgattcagccacctacctctgtgcaatgcggattcagggagcccagaagctggtatttggccaaggaaccaggctgactatcaaccca

SEQ ID NO: 1082 - DNA, 420 bp, Homo sapiens
  TCR 48 - Beta Native
gctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaggcagggtctcctacgagcagtacttcgggccgggcaccaggctcacggtcaca

SEQ ID NO: 1083 - DNA, 508 bp, Homo sapiens
  TCR 49 - Alpha Native
gaaagcagattctttttatgatttttaaagtagaaatatccattctaggtgcattttttaagggtttaaaatttgaatcctcagtgaaccagggcagagaagaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatagggacctcaggaacctacaaatacatctttggaacaggcaccaggctgaaggttttagca

SEQ ID NO: 1084 - DNA, 417 bp, Homo sapiens
  TCR 49 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcactccaaggtattcctacgagcagtacttcgggccgggcaccaggctcacggtcaca

SEQ ID NO: 1085 - DNA, 419 bp, Homo sapiens
  TCR 50 - Alpha Native
ggcaggtcccagtggggagaacaatgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagtccccctggaacctacaaatacatctttggaacaggcaccaggctgaaggttttagca

SEQ ID NO: 1086 - DNA, 421 bp, Homo sapiens
  TCR 50 - Beta Native
gagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcactattataatggagaagagagagcaaaaggaaacattcttgaacgattctccgcacaacagttccctgacttgcactctgaactaaacctgagctctctggagctgggggactcagctttgtatttctgtgccagcagcgccaccagggacgcctatggctacaccttcggttcggggaccaggttaaccgttgta

SEQ ID NO: 1087 - DNA, 511 bp, Homo sapiens
  TCR 51 - Alpha Native
gaaagcagattctttttatgatttttaaagtagaaatatccattccaggtgcattttttaagggtttaaaatttgaatcctcagtgaaccagggcagagaagaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgtccatatactccaatggtgacaaagaagatggaaggtttacagcacagctcaataaagccagccagtatgtttctctgctcatcagagactcccagcccagtgattcagccacctacctctgtgccgtgaacatgagaggtggaggtagcaactataaactgacatttggaaaaggaactctcttaaccgtgaatcca

SEQ ID NO: 1088 - DNA, 417 bp, Homo sapiens
  TCR 51 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatcgctagtagggtatcctacgagcagtacttcgggccgggcaccaggctcacggtcaca

SEQ ID NO: 1089 - DNA, 467 bp, Homo sapiens
  TCR 52 - Alpha Native
gagcccagagaagtctgttccaggacgggctctttcaggagcagctaaagtcaggggccatgtccaccatgtgatagaaagacaagatggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggagcgagggactacaagctcagctttggagccggaaccacagtaactgtaagagca

SEQ ID NO: 1090 - DNA, 421 bp, Homo sapiens
  TCR 52 - Beta Native
gagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgtaggggacttaaacaatgagcagttcttcgggccagggacacggctcaccgtgcta

SEQ ID NO: 1091 - DNA, 416 bp, Homo sapiens
  TCR  53- Alpha Native
gcttagctggagccatggcctctgcacccatctcgatgcttgcgatgctcttcacattgagtgggctgagagctcagtcagtggctcagccggaagatcaggtcaacgttgctgaagggaatcctctgactgtgaaatgcacctattcagtctctggaaacccttatcttttttggtatgttcaataccccaaccgaggcctccagttccttctgaaatacatcacaggggataacctggttaaaggcagctatggctttgaagctgaatttaacaagagccaaacctccttccacctgaagaaaccatctgcccttgtgagcgactccgctttgtacttctgtgctgtgagagactttggctcaggaacctacaaatacatctttggaacaggcaccaggctgaaggttttagca

SEQ ID NO: 1092 - DNA, 453 bp, Homo sapiens
  TCR 53 - Beta Native
gacagtgacactgatctggtaaagccctcatcctgtcctgaccctgccatgggcaccagtctcctatgctgggtggtcctgggtttcctagggacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagcggctccgggactagcggctacaatgagcagttcttcgggccagggacacggctcaccgtgcta

SEQ ID NO: 1093 - DNA, 440 bp, Homo sapiens
  TCR 54 - Alpha Native
gaagtcaacttctgggagcagatctctgcagaataaaaatgaaaaagcatctgacgaccttcttggtgattttgtggctttatttttatagggggaatggcaaaaaccaagtggagcagagtcctcagtccctgatcatcctggagggaaagaactgcactcttcaatgcaattatacagtgagccccttcagcaacttaaggtggtataagcaagatactgggagaggtcctgtttccctgacaatcatgactttcagtgagaacacaaagtcgaacggaagatatacagcaactctggatgcagacacaaagcaaagctctctgcacatcacagcctcccagctcagcgattcagcctcctacatctgtgtggtgagccgggataactatggtcagaattttgtctttggtcccggaaccagattgtccgtgctgccc

SEQ ID NO: 1094 - DNA, 417 bp, Homo sapiens
  TCR 54 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccattacagaccgcactaactatggctacaccttcggttcggggaccaggttaaccgttgta

SEQ ID NO: 1095 - DNA, 507 bp, Homo sapiens
  TCR 55 - Alpha Native
gagatgcctctgtggacagtttaagaaaccacagtgctttggaggaaaggaagagatacttgataatatagctctcttggctggagattgcaggtcccagtggggagaacaatgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagtcccctcgggtgctacaaacaagctcatctttggaactggcactctgcttgctgtccagcca

SEQ ID NO: 1096 - DNA, 66 bp, Artificial Sequence
  TCR 50/ TCR 54 P2A
ggcagcggcgccaccaacttcagcctgcttaaacaggcaggcgacgtggaggagaatcctggccca

SEQ ID NO: 1097 - DNA, 402 bp, Homo sapiens
  TCR 15 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgaagcctggcggctacaacaagctgatcttcggagccggcaccagactggccgtgcaccct

SEQ ID NO: 1098 - DNA, 402 bp, Homo sapiens
  TCR 15 Codon-optimized/ cysteine-modified beta
atggacagctggaccttttgctgcgtgtccctgtgcatcctggtggccaagcacaccgatgccggcgtgatccagagccccagacacgaagtgaccgagatgggccaggaagtgaccctgcgctgcaagcccatcagcggccacaacagcctgttctggtacagacagaccatgatgcggggcctggaactgctgatctacttcaacaacaacgtgcccatcgacgacagcggcatgcccgaggacagattcagcgccaagatgcccaacgccagcttcagcaccctgaagatccagcccagcgagcccagagacagcgccgtgtacttttgcgccagcagcctcgtgggcagaagccggaccgagcagtactttggccctggcaccagactgaccgtgacc

SEQ ID NO: 1099 - DNA, 393 bp, Homo sapiens
  TCR 16 Codon-optimized/ cysteine-modified alpha
atggaaaccctgctgggcctgctgatcctgtggctgcagctccagtgggtgtccagcaagcaggaagtgacccagatccctgccgccctgtctgtgcctgagggcgagaacctggtgctgaactgcagcttcaccgacagcgccatctacaacctgcagtggttccggcaggaccccggcaagggactgacaagcctgctgctgattcagagcagccagagagagcagaccagcggcagactgaacgccagcctggacaagtcctccggcagaagcaccctgtatatcgccgcctcccagcctggcgatagcgccacatatctgtgtgccgtgcggcctgccaacaacaacgacatgagattcggagccggcacccggctgaccgtgaagcct

SEQ ID NO: 1100 - DNA, 399 bp, Homo sapiens
  TCR 16 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggcagaagcaaccagcctcagcacttcggcgacggcaccagactgagcatcctc

SEQ ID NO: 1101 - DNA, 402 bp, Homo sapiens
  TCR 17 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccccagctacggcctgttctggtacaagcagcccagcagcggcgagatgatcttcctgatctaccagggcagctacgaccagcagaacgccaccgagggccggtacagcctgaacttccagaaggcccggaagtccgccaacctggtcatctctgccagccagctgggcgacagcgccatgtacttttgcgccatgagagagggcagaggcgacaagatcattttcggcaagggcacccggctgcacatcctgccc

SEQ ID NO: 1102 - DNA, 399 bp, Homo sapiens; identical to SEQ ID NO: 1100
  TCR 17 Codon-optimized/ cysteine-modified beta

SEQ ID NO: 1103 - DNA, 402 bp, Homo sapiens
  TCR 18 Codon-optimized/ cysteine-modified alpha
atggaaaccctgctgggcctgctgatcctgtggctgcagctccagtgggtgtccagcaagcaggaagtgacccagatccctgccgccctgtctgtgcctgagggcgagaacctggtgctgaactgcagcttcaccgacagcgccatctacaacctgcagtggttccggcaggaccccggcaagggactgacaagcctgctgctgattcagagcagccagagagagcagaccagcggcagactgaacgccagcctggacaagtcctccggcagaagcaccctgtatatcgccgcctcccagcctggcgatagcgccacatatctgtgcgccgagggcaatgccggcggaaccagctacggcaagctgacctttggccagggcaccatcctgaccgtgcacccc

SEQ ID NO: 1104 - DNA, 399 bp, Homo sapiens
  TCR 18 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcttctggggcagaagcaacagccctctgcacttcggcaacggcaccagactgaccgtgacc

SEQ ID NO: 1105 - DNA, 408 bp, Homo sapiens
  TCR 19 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagaacaccggcaccgccagcaagctgaccttcggcacaggcaccagactgcaggtcacactg

SEQ ID NO: 1106 - DNA, 399 bp, Homo sapiens
  TCR 19 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcagctggggccagagcacaggcgagcagtactttggccctggcaccagactgaccgtgacc

SEQ ID NO: 1107 - DNA, 405 bp, Homo sapiens
  TCR 20 Codon-optimized/ cysteine-modified alpha
atgaacatgctgaccgccagcctgctgagagccgtgatcgccagcatctgcgtggtgtccagcatggcccagaaagtgacccaggcccagaccgagatcagcgtggtggaaaaagaagatgtgaccctggactgcgtgtacgagacacgggacaccacctactacctgttctggtacaagcagcctcccagcggcgagctggtgttcctgatcagacggaacagcttcgacgagcagaacgagattagcggccggtacagctggaacttccagaagtccaccagcagcttcaacttcaccatcaccgcctcccaggtggtggacagcgccgtgtacttttgtgccctgtggaccggggccaacaacctgttctttggcaccggaacccggctgaccgtgatcccc

SEQ ID NO: 1108 - DNA, 393 bp, Homo sapiens
  TCR 20 Codon-optimized/ cysteine-modified beta
atgctgctgctcctgctcctcctgggacctggatctggactgggagccgtggtgtcccagcaccccagcagagtgatctgcaagagcggcaccagcgtgaagatcgagtgcagaagcctggacttccaggccaccaccatgttctggtacagacagttccccaagcagagcctgatgctgatggccacctccaacgagggcagcaaggccacatacgagcagggcgtggaaaaggacaagttcctgatcaaccacgccagcctgaccctgagcaccctgacagtgacaagcgcccaccccgaggacagcagcttctacatctgtagcgccagcagcctggccagaagaagctacgagcagtacttcggccctggcaccagactgaccgtgacc

SEQ ID NO: 1109 - DNA, 414 bp, Homo sapiens
  TCR 21 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcgcgagggcagagtgaccggcggaggcaacaagctgacctttggcaccggcacccagctgaaagtggaactg

SEQ ID NO: 1110 - DNA, 441 bp, Homo sapiens
  TCR 21 Codon-optimized/ cysteine-modified beta
atgcacagacctagaaggcccctgcatcccgtggcccctgccatgtctatcggcctgctgtgctgcgtggcattctccctgctgtgggcctctcctgtgaatgccggcgtgacccagacccctaagttccaggtgctgaaaaccggccagagcatgaccctgcagtgcgcccaggacatgaaccacaacagcatgtactggtacagacaggaccccggcatgggcctgcggctgatctactatagcgccagcgagggcaccaccgacaagggcgaggtgcccaacggctacaacgtgtcccggctgaacaagagagagttcagcctgagactggaaagcgccgctcccagccagaccagcgtgtacttctgtgccagcagaccctggggcaaccagaacaccgaggcattctttgggcagggcacccggctgacagtggtc

SEQ ID NO: 1111 - DNA, 438 bp, Homo sapiens
  TCR 22 Codon-optimized/ cysteine-modified alpha
atggcccaggaactgggcatgcagtgtcaggccagaggcatcctgcagcagatgtggggcgtgttcctgctgtacgtgtccatgaagatgggcggcaccaccggccagaacatcgaccagcctaccgagatgaccgccaccgagggcgctatcgtgcagatcaactgcacctaccagaccagcggcttcaacggcctgttctggtatcagcagcacgccggcgaggcccctaccttcctgagctacaatgtgctggacggcctggaagagaagggccggttcagcagcttcctgtccagaagcaagggctacagctacctgctgctgaaagaactgcagatgaaggacagcgcctcctacctgtgtgccgtgcgggccagaatggacagcaactaccagctgatctggggagccggcaccaagctgatcatcaagccc

SEQ ID NO: 1112 - DNA, 393 bp, Homo sapiens
  TCR 22 Codon-optimized/ cysteine-modified beta
atgggacctggactgctgtgctgggtgctgctgtgtctgctgggagccggacctgtggatgccggcgtgacacagagccccacccacctgatcaagaccagaggccagcacgtgaccctgcggtgtagccctatcagcggccacaagagcgtgtcctggtatcagcaggtcctgggccagggccctcagttcatcttccagtactacgagaaagaggaacgcggcagaggcaacttccccgacagattcagcgccagacagttccccaactacagcagcgagctgaacgtgaacgccctgctgctgggcgatagcgccctgtacctgtgtgccagcagccggaccgagaactacggctacaccttcggcagcggcaccagactgacagtggtc

SEQ ID NO: 1113 - DNA, 408 bp, Homo sapiens
  TCR 23 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagcccacctggcggcagcgccagacagctgacatttggctctggcacccagctgaccgtgctgccc

SEQ ID NO: 1114 - DNA, 399 bp, Homo sapiens
  TCR 23 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcccctggggccagtctaatcagcctcagcacttcggcgacggcacccggctgtctattctc

SEQ ID NO: 1115 - DNA, 411 bp, Homo sapiens
  TCR 24 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagggcagaggcgacagctggggcaagctgcagtttggagccggcacccaggtggtcgtgacccct

SEQ ID NO: 1116 - DNA, 399 bp, Homo sapiens
  TCR 24 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagccctttcggcagaggcagctacgagcagtacttcggccctggcaccagactgaccgtgacc

SEQ ID NO: 1117 - DNA, 414 bp, Homo sapiens
  TCR 25 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagggcagcctgaccggcggaggcaacaagctgacctttggcaccggcacccagctgaaagtggaactg

SEQ ID NO: 1118 - DNA, 399 bp, Homo sapiens
  TCR 25 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggccagagcaatcagcctcagcacttcggcgacggcacccggctgtctattctc

SEQ ID NO: 1119 - DNA, 402 bp, Homo sapiens
  TCR 26 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcgggacgcccggaacaacgacatgagattcggagccggcacccggctgaccgtgaagcct

SEQ ID NO: 1120 - DNA, 399 bp, Homo sapiens
  TCR 26 Codon-optimized/ cysteine-modified beta
atgtctctgggactgctgtgctgcggagccttctctctgctgtgggccggacctgtgaatgccggcgtgacccagacccctaagttccgggtgctgaaaaccggccagagcatgaccctgctgtgcgcccaggacatgaaccacgagtacatgtattggtacagacaggaccccggcatgggcctgcggctgatccactattctgtgggcgagggcaccaccgccaagggcgaagtgcctgacggctacaacgtgtcccggctgaagaagcagaacttcctgctgggcctggaaagcgccgctcctagccagaccagcgtgtacttctgcgccagcagctactacgccagcggccggaactacgagcagtacttcggccctggcacccggctgacagtg

SEQ ID NO: 1121 - DNA, 393 bp, Homo sapiens
  TCR 27 Codon-optimized/ cysteine-modified alpha
atgaagctggtcaccagcatcaccgtgctgctgagcctgggaatcatgggcgacgccaagaccacccagcccaacagcatggaaagcaacgaagaggaacccgtgcatctgccctgcaaccacagcaccatcagcggcaccgactacatccactggtacagacagctgcccagccagggccccgagtatgtgatccacggcctgaccagcaacgtgaacaaccggatggcctccctggccattgccgaggacagaaagagcagcaccctgatcctgcaccgggccacactgagagatgccgccgtgtactactgcatcctgcgggtgccacctcagagcggcggctaccagaaagtgaccttcggcaccggcaccaagctgcaggtcatcccc

SEQ ID NO: 1122 - DNA, 441 bp, Homo sapiens
  TCR 27 Codon-optimized/ cysteine-modified beta
atgcacagacctagaaggcccctgcatcccgtggcccctgccatgtctatcggcctgctgtgctgcgtggcattctccctgctgtgggcctctcctgtgaatgccggcgtgacccagacccctaagttccaggtgctgaaaaccggccagagcatgaccctgcagtgcgcccaggacatgaaccacaacagcatgtactggtacagacaggaccccggcatgggcctgcggctgatctactatagcgccagcgagggcaccaccgacaagggcgaggtgcccaacggctacaacgtgtcccggctgaacaagagagagttcagcctgagactggaaagcgccgctcccagccagaccagcgtgtacttttgcgccagcagcgagttcggcagcctgaacgagaagctgttcttcggcagcggcacccagctgagcgtgctc

SEQ ID NO: 1123 - DNA, 402 bp, Homo sapiens
  TCR 28 Codon-optimized/ cysteine-modified alpha
atgatgatcagcctgcgggtgctgctggtcatcctgtggctgcagctgagctgggtctggtcccagcggaaagaggtggaacaggaccctggccccttcaacgtgccagagggcgctaccgtggccttcaactgcacctacagcaacagcgccagccagagcttcttctggtacagacaggactgccggaaagaacccaagctgctgatgagcgtgtacagcagcggcaacgaggacggcagattcaccgcccagctgaaccgggccagccagtacatctccctgctgatccgggacagcaagctgagcgacagcgccacctatctgtgtgtcgtgcggggaggcggcaccagctacggcaagctgacatttggccagggcaccatcctgaccgtgcacccc

SEQ ID NO: 1124 - DNA, 402 bp, Homo sapiens
  TCR 28 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggcagaagcagcggcaacaccatctacttcggcgagggcagctggctgaccgtggtc

SEQ ID NO: 1125 - DNA, 408 bp, Homo sapiens
  TCR 29 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcggctgaacaccggcaccgccagcaagctgaccttcggcacaggcaccagactgcaggtcacactg

SEQ ID NO: 1126 - DNA, 399 bp, Homo sapiens
  TCR 29 Codon-optimized/ cysteine-modified beta
atgagcaatcaggtgctgtgctgcgtggtcctgtgcctgctgggagccaataccgtggatggcggcatcacccagagccccaagtacctgttccggaaagagggccagaacgtcaccctgagctgcgagcagaacctgaaccacgacgccatgtactggtacagacaggaccccggccagggcctgcggctgatctactacagccagatcgtgaacgacttccagaagggcgacattgccgagggctacagcgtgtccagagagaagaaagagtccttcccactgaccgtgaccagcgcccagaagaaccccaccgccttctacctgtgtgccagctctccttggggcagagccaccaacgagcagttcttcggccctggcaccaggctgacagtgctg

SEQ ID NO: 1127 - DNA, 393 bp, Homo sapiens
  TCR 30 Codon-optimized/ cysteine-modified alpha
atgcggctggtggccagagtgaccgtgttcctgaccttcggcaccatcatcgacgccaagaccacccagcctcccagcatggattgtgccgagggcagagccgccaacctgccctgcaatcacagcaccatcagcggcaacgagtacgtgtactggtacagacagatccacagccagggccctcagtacatcatccacggcctgaagaacaacgagacaaacgagatggccagcctgatcatcaccgaggacagaaagagcagcaccctgatcctgccccacgccaccctgagagacaccgccgtgtactactgtatcgtgcggggcacaagcgtgctgcagggcaacgagaagctgacatttggcaccggcacccggctgaccatcatcccc

SEQ ID NO: 1128 - DNA, 402 bp, Homo sapiens
  TCR 30 Codon-optimized/ cysteine-modified beta
atggatacctggctcgtgtgctgggccatcttcagcctgctgaaggccggactgaccgagcccgaagtgacccagacacccagccaccaggtcacacagatgggccaggaagtgatcctgcgctgcgtgcccatcagcaaccacctgtacttctactggtacagacagatcctgggccagaaggtggaattcctcgtcagcttctacaacaacgagatcagcgagaagtccgagattttcgacgaccagttcagcgtggaacggcccgacggcagcaacttcaccctgaagatcagaagcaccaagctcgaggacagcgccatgtacttttgcgccagcagcagacagcccagcagcggcaacaccatctacttcggcgagggcagctggctgaccgtggtc

SEQ ID NO: 1129 - DNA, 414 bp, Homo sapiens
  TCR 31 Codon-optimized/ cysteine-modified alpha
atggccatgctgctgggagcctctgtgctgatcctgtggctccagcccgactgggtcaacagccagcagaagaacgacgaccagcaggtcaaacagaacagccccagcctgagcgtgcaggaaggccggatcagcatcctgaactgcgactacaccaacagcatgttcgactactttctgtggtacaagaagtaccccgccgagggccccaccttcctgatctccatcagcagcatcaaggacaagaacgaggacggccggttcaccgtgtttctgaacaagagcgccaagcacctgagcctgcacatcgtgcctagccagcctggcgacagcgccgtgtacttttgtgccgccagcgagcggggcacctacaagtacatcttcggcaccggcacccggctgaaggtgctggct

SEQ ID NO: 1130 - DNA, 402 bp, Homo sapiens
  TCR 31 Codon-optimized/ cysteine-modified beta
atgggcaccagactgctgttctgggtggccttctgcctgctgggagccgatcatacaggtgccggcgtgtcccagagccccagcaacaaagtgaccgagaagggcaaggacgtggaactgagatgcgaccccatcagcggccacaccgccctgtactggtacagacagtctctgggccagggcctggaattcctgatctattttcagggcaacagcgcccctgacaagagcggcctgcccagcgatagattcagcgccgagagaacaggcggcagcgtgtccaccctgaccatccagagaacccagcaggaagatagcgccgtctacctgtgcgccagcagcagattcctgggcagcaccgacacccagtacttcggcccaggcaccaggctgacagtgctg

SEQ ID NO: 1131 - DNA, 381 bp, Homo sapiens
  TCR 32 Codon-optimized/ cysteine-modified alpha
atggtgctgaagttcagcgtgtccatcctgtggatccagctggcctgggtgtccacccagctgctggaacagagccctcagttcctgagcatccaggaaggcgagaacctgaccgtgtactgcaacagcagcagcgtgttcagcagcctgcagtggtacagacaggaacccggcgagggacctgtgctgctggtcacagtcgtgacaggcggcgaagtgaagaagctgaagcggctgaccttccagttcggcgacgccagaaaggacagctccctgcacattacagccgcccagcctggcgataccggcctgtatctgtgtgccggcggaagcaactacaagctgacctttggcaagggcaccctgctgaccgtgaacccc

SEQ ID NO: 1132 - DNA, 399 bp, Homo sapiens
  TCR 32 Codon-optimized/ cysteine-modified beta
atgggcttcagactgctgtgctgcgtggccttctgtctgctgggagccggacctgtggatagcggcgtgacccagacccctaagcacctgatcaccgccaccggccagcgcgtgacactgagatgtagccctagaagcggcgacctgagcgtgtactggtatcagcagagcctggaccagggcctgcagttcctgatccagtactacaacggcgaggaacgggccaagggcaacatcctggaacggttcagcgcccagcagttccccgatctgcacagcgagctgaacctgagcagcctggaactgggcgacagcgccctgtacttctgtgcctcttctgtgggcggcgaccacagcgacgagcagttttttggccctggcacccggctgaccgtgctg

SEQ ID NO: 1133 - DNA, 405 bp, Homo sapiens
  TCR 33 Codon-optimized/ cysteine-modified alpha
atgatgaagtccctgcgggtgctgctggtcatcctgtggctgcagctgagctgggtctggtcccagcagaaagaggtggaacagaacagcggcccactgagcgtgccagagggcgctatcgccagcctgaactgcacctacagcgaccggggcagccagagcttcttctggtacagacagtacagcggcaagagccccgagctgatcatgttcatctacagcaacggcgacaaagaggacggccggttcaccgcccagctgaacaaggccagccagtacgtgtccctgctgatcagagacagccagcccagcgacagcgccacctacctgtgtgccgtgaatgcccaccacaccggcggcttcaagaccatctttggagccggcacccggctgttcgtgaaggcc

SEQ ID NO: 1134 - DNA, 396 bp, Homo sapiens
  TCR 33 Codon-optimized/ cysteine-modified beta
atggatacctggctcgtgtgctgggccatcttcagcctgctgaaggccggactgaccgagcccgaagtgacccagacacccagccaccaggtcacacagatgggccaggaagtgatcctgcgctgcgtgcccatcagcaaccacctgtacttctactggtacagacagatcctgggccagaaggtggaattcctcgtcagcttctacaacaacgagatcagcgagaagtccgagattttcgacgaccagttcagcgtggaacggcccgacggcagcaacttcaccctgaagatcagaagcaccaagctcgaggacagcgccatgtacttttgcgccagcacccctcgggacacctacgagcagtacttcggccctggcaccagactgaccgtgacc

SEQ ID NO: 1135 - DNA, 381 bp, Homo sapiens
  TCR 34 Codon-optimized/ cysteine-modified alpha
atgaagaaactgctggccatgatcctgtggctgcagctggacagactgagcggcgagctgaaggtggaacagaaccctctgttcctgagcatgcaggaaggcaagaactacaccatctactgcaactacagcaccaccagcgaccggctgtactggtacagacaggaccccggcaagagcctggaaagcctgttcgtgctgctgagcaacggggccgtgaagcaggaaggacggctgatggccagcctggacaccaaggccagactgtccaccctgcacatcacagccgccgtgcacgacctgagcgccacctacttttgtgccgtgtccggcacctacaagtacatcttcggcaccggcaccagactgaaggtgctggcc

SEQ ID NO: 1136 - DNA, 396 bp, Homo sapiens
  TCR 34 Codon-optimized/ cysteine-modified beta
atgggacctggactgctgtgttgggccctgctgtgtctgctgggagccggatctgtggaaaccggcgtgacccagagccccacccacctgatcaagaccagaggccagcaggtcacactgcggtgtagcagccagagcggccacaacaccgtgtcctggtatcagcaggccctgggccagggaccccagttcatcttccagtactaccgcgaggaagagaacggcagaggcaacttcccaccccggttcagcggcctgcagttccccaattacagcagcgagctgaacgtgaacgccctggaactggacgacagcgccctgtacctgtgcgcctctagcagctacgccggcagctacgagcagtacttcggccctggcaccagactgaccgtgacc

SEQ ID NO: 1137 - DNA, 387 bp, Homo sapiens
  TCR 35 Codon-optimized/ cysteine-modified alpha
atggctctgcagtctacactgggagctgtgtggctgggcctgctgctgaattctctgtggaaggtggccgagagcaaggaccaggtgttccagccttctacagtggcctcttctgagggcgccgtggtggaaatcttctgcaaccacagcgtgtccaacgcctacaacttcttctggtatctgcacttccccggctgcgcccctagactgcttgtgaagggaagcaagcctagccagcagggcagatacaacatgacctacgagcggttcagcagctccctgctgattctgcaagtgcgggaagccgatgccgccgtgtattattgtgctgtggccggcgactacaagctgagctttggagccggcaccacagtgacagtgcgggct

SEQ ID NO: 1138 - DNA, 402 bp, Homo sapiens
  TCR 35 Codon-optimized/ cysteine-modified beta
atgggctttagactgctgtgctgcgtggccttctgtctgcttggagctggccctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagcaccacaagcggcgatagcagctacaacgagcagttcttcggccctggcaccagactgacagttctg

SEQ ID NO: 1139 - DNA, 399 bp, Homo sapiens
  TCR 36 Codon-optimized/ cysteine-modified alpha
atgatgatcagcctgcgggtgctgctggtcatcctgtggctgcaactgagctgggtctggtcccagcggaaagaggtggaacaggaccccggacctttcaatgtgcctgaaggcgccaccgtggccttcaactgcacctacagcaatagcgccagccagagcttcttctggtacagacaggactgccggaaagaacccaagctgctgatgagcgtgtacagcagcggcaacgaggacggcagattcacagcccagctgaacagagccagccagtacatctccctgctgatccgggatagcaagctgagcgatagcgccacctacctgtgcgtggtcaacagagacaactacggccagaacttcgtgttcggccctggcacaagactgagcgtgctgcct

SEQ ID NO: 1140 - DNA, 396 bp, Homo sapiens
  TCR 36 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatgaccggcagaagcaactacgagcagtacttcggccctggcaccagactgacagtgaca

SEQ ID NO: 1141 - DNA, 390 bp, Homo sapiens
  TCR 37 Codon-optimized/ cysteine-modified alpha
atgaagaaactgctggccatgatcctgtggctgcagctggatagactgagcggcgagctgaaggtggaacagaaccctctgttcctgagcatgcaagagggcaagaactacaccatctactgcaactacagcaccaccagcgaccggctgtactggtacagacaggatccaggcaagagcctggaaagcctgttcgtgctgctgagcaatggcgccgtgaaacaagagggtagactgatggccagcctggacaccaaggccagactgagcacactgcacattacagccgccgtgcacgatctgagcgccacctatttttgtgccggctactctggcgccggaagctaccagctgacatttggcaagggcaccaagctgagcgtgatcccc

SEQ ID NO: 1142 - DNA, 399 bp, Homo sapiens
  TCR 37 Codon-optimized/ cysteine-modified beta
atgggaacaagactgctgtgttgggtcgtgctgggcttcctgggcacagatcatacaggtgccggtgtctctcagagccccagatacaaggtggccaagcgcggacaggatgtggccctgagatgtgatcctatcagcggccacgtgtccctgttctggtatcagcaggctctcggacagggccccgagttcctgacctactttcagaatgaggcccagctggacaagagcggcctgcctagcgatagattcttcgccgaaagacccgagggcagcgtgtccacactgaagatccagagaacccagcaagaggacagcgccgtgtacctgtgtgcctctagtctgctgctgggcgcctacggctacacatttggctctggcaccagactgaccgtggtc

SEQ ID NO: 1143 - DNA, 414 bp, Homo sapiens
  TCR 38 Codon-optimized/ cysteine-modified alpha
atggtcaagatgcctggcgctagacggcagagcatcatgaagagaattctgggcgccctgctgggcctgctgtctgcccaagtttgttgtgtgcggggcatccaggtggaacagagccctcctgatctgatcctgcaagagggcgccaacagcaccctgagatgcaacttcagcgacagcgtgaacaacctgcagtggttccaccagaatccttggggccagctgatcaacctgttctacatccccagcggcaccaagcagaacggcagactgtctgctaccaccgtggccaccgagagatacagcctgctgtacatcagcagcagccagaccacagacagcggcgtgtacttttgcgccgtgggcttcaacgacatgagattcggagccggcaccagactgaccgtgaagcct

SEQ ID NO: 1144 - DNA, 396 bp, Homo sapiens
  TCR 38 Codon-optimized/ cysteine-modified beta
atgggacctggactgctttgttgggtgctgctgtgtctgctcggagccggatctgtggaaacaggcgtgacacagagccccacacacctgatcaagaccagaggccagcaagtgaccctgagatgcagctctcagagcggccacaataccgtgtcctggtatcagcaggccctcggacagggccctcagttcatcttccagtactacagagaggaagagaacggcagaggcaacttcccacctagattcagcggcctgcagttccccaactacagcagcgagctgaacgtgaacgccctggaactggatgacagcgccctgtacctgtgtgcctcttctcttgtggctggcggcgagacacagtactttggccccggaacaagactgctggtgctg

SEQ ID NO: 1145 - DNA, 357 bp, Homo sapiens
  TCR 39 Codon-optimized/ cysteine-modified alpha
atgcagctgacatgggtttccggccagcagctgaatcagagccctcagagcatgttcatccaagaaggcgaggacgtttccatgaactgcaccagcagcagcatcttcaacacctggctgtggtacaagcaagagcctggcgaaggacccgtgctgctgatcgctctttacaaggccggcgagctgaccagcaacggcagactgacagcccagttcggcattacccggaaggacagcttcctgaacatcagcgccagcattcccagcgacgtgggcatctatttctgcgccggctacagcagctccaacgactacaagctgagcttcggagccggcaccaccgtgacagttagagcc

SEQ ID NO: 1146 - DNA, 399 bp, Homo sapiens
  TCR 39 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacacccagagacagaggcaaagaggccttcttcggccaaggcaccagactgacagtggtc

SEQ ID NO: 1147 - DNA, 492 bp, Homo sapiens
  TCR 40 Codon-optimized/ cysteine-modified alpha
atgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctacttttgcgccggcagaaacaacttcaacaagttctacttcggcagcggcaccaagctgaacgtgaagccc

SEQ ID NO: 1148 - DNA, 396 bp, Homo sapiens
  TCR 40 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatcaccgccagaagcagctacgagcagtatttcggccctggcaccagactgaccgtgaca

SEQ ID NO: 1149 - DNA, 402 bp, Homo sapiens
  TCR 41 Codon-optimized/ cysteine-modified alpha
atgatgatcagcctgcgggtgctgctggtcatcctgtggctgcaactgagctgggtctggtcccagcggaaagaggtggaacaggaccccggacctttcaatgtgcctgaaggcgccaccgtggccttcaactgcacctacagcaatagcgccagccagagcttcttctggtacagacaggactgccggaaagaacccaagctgctgatgagcgtgtacagcagcggcaacgaggacggcagattcacagcccagctgaacagagccagccagtacatctccctgctgatccgggatagcaagctgagcgatagcgccacctacctgtgcgtggtcacatttgctctgaccggcggcttcaagaccatcttcggagccggcaccagactgttcgtgaaggcc

SEQ ID NO: 1150 - DNA, 402 bp, Homo sapiens
  TCR 41 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaatccccgggacagagtgtcctacgagcagtactttggccctggcaccagactgaccgtgaca

SEQ ID NO: 1151 - DNA, 492 bp, Homo sapiens
  TCR 42 Codon-optimized/ cysteine-modified alpha
atgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctacttttgcgccggacctgacaacttcaacaagttctacttcggcagcggcaccaagctgaacgtgaagccc

SEQ ID NO: 1152 - DNA, 396 bp, Homo sapiens
  TCR 42 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccaagaccagcagaagcagctacgagcagtacttcggccctggcaccagactgacagtgaca

SEQ ID NO: 1153 - DNA, 405 bp, Homo sapiens
  TCR 43 Codon-optimized/ cysteine-modified alpha
atgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgtgccgtgaatgtgcctaccagcggcacctacaagtacatcttcggcaccggcaccagactgaaggtgctggct

SEQ ID NO: 1154 - DNA, 396 bp, Homo sapiens
  TCR 43 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacacccagagacagctacgagcagtatttcggccctggcaccagactgaccgtgaca

SEQ ID NO: 1155 - DNA, 432 bp, Homo sapiens
  TCR 44 Codon-optimized/ cysteine-modified alpha
atggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgtgcccagtactctggcggctaccagaaagtgacctttggcaccggcaccaagctgcaagtgatcccc

SEQ ID NO: 1156 - DNA, 387 bp, Homo sapiens
  TCR 44 Codon-optimized/ cysteine-modified beta
atgggctttagactgctgtgctgcgtggccttctgtctgcttggagctggccctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagcagcggcacacccgacacacagtattttggccctggcaccagactgaccgtg

SEQ ID NO: 1157 - DNA, 498 bp, Homo sapiens
  TCR 45 Codon-optimized/ cysteine-modified alpha
atgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctatttttgcgccggatcttctggcgccggaagctaccagctgacatttggcaagggcaccaagctgagcgtgatcccc

SEQ ID NO: 1158 - DNA, 402 bp, Homo sapiens
  TCR 45 Codon-optimized/ cysteine-modified beta
atgggaaccagactgctgttctgggtcgccttctgtctgctgggcgcctatcatacaggtgccggtgtctctcagagccccagcaacaaagtgaccgagaagggcaaagacgtggaactgagatgcgaccccatcagcggacacacagccctgtactggtacagacagagactcggccagggcctcgagttcctgatctacttccaaggcaacagcgcccctgacaagagcggcctgcctagcgatagattcagcgccgagagaacaggcgagagcgtgtccacactgaccatccagagaacccagcaagaggacagcgccgtgtacctgtgtgccagctctctgtacctgggaaccaccggcgagctgttctttggcgagggctctagactgaccgtgctg

SEQ ID NO: 1159 - DNA, 399 bp, Homo sapiens
  TCR 46 Codon-optimized/ cysteine-modified alpha
atgctgctgcttctggtgcccgccttccaagtgatctttaccctcggcggaacacgggcccagtctgtgacacagctggattctcaggtgcccgtgtttgaggaagcccctgtcgagctgagatgcaactacagcagcagcgtgtccgtgtacctgttttggtacgtgcagtaccccaaccagggcctgcagctgctgctcaagtatctgagcggcagcacactggtcaagggcatcaatggcttcgaggccgagttcaacaagagccagaccagcttccatctgcggaagcccagcgtgcacatcagcgataccgccgagtacttctgcgccgtgtctcctagcagcggcacctacaagtacatcttcggcaccggcaccagactgaaggtgctggct

SEQ ID NO: 1160 - DNA, 402 bp, Homo sapiens
  TCR 46 Codon-optimized/ cysteine-modified beta
atgggaacaagactgctgtgttgggccgctctgtgtctgctgggagctgatcatacaggcgccggtgtcagccagacacctagcaacaaagtgaccgagaagggcaaatacgtggaactgagatgcgaccccatcagcggacacacagccctgtactggtacagacagtctctcggccagggacctgagttcctgatctacttccaaggcaccggcgctgccgatgatagcggcctgcctaacgatagattcttcgccgtcagacccgagggcagcgtgtccacactgaagatccagagaaccgagaggggcgacagcgccgtgtatctgtgtgccagctctctgtatctcggcggcagcgagacacagtactttggccctggtacacggctgctggttctg

SEQ ID NO: 1161 - DNA, 405 bp, Homo sapiens
  TCR 47 Codon-optimized/ cysteine-modified alpha
atgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgtgccgtgaatctgctgagcggcagcgctagacagctgacatttggctctggcacccagctgaccgtgctgcct

SEQ ID NO: 1162 - DNA, 396 bp, Homo sapiens
  TCR 47 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatgaccggcagaaccacctacgagcagtatttcggccctggcaccagactgaccgtgaca

SEQ ID NO: 1163 - DNA, 399 bp, Homo sapiens
  TCR 48 Codon-optimized/ cysteine-modified alpha
atgatgaagtccctgcgggtgctgctggtcatcctgtggctgcaactgagctgggtctggtcccagcagaaagaggtggaacaggaccctggacctctgtctgttcctgagggcgccatcgtgtccctgaactgcacctacagcaacagcgccttccagtacttcatgtggtacagacagtacagccggaagggccccgagctgctgatgtacacatacagcagcggcaacaaagaggacggccggtttacagcccaggtggacaagagcagcaagtacatctccctgttcatccgggacagccagcctagcgatagcgccacatatctgtgcgccatgagaatccagggcgcccagaaactggtgttcggccagggaaccagactgaccatcaatccc

SEQ ID NO: 1164 - DNA, 396 bp, Homo sapiens
  TCR 48 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaccggcagagtgtcctacgagcagtatttcggccctggcaccagactgaccgtgaca

SEQ ID NO: 1165 - DNA, 405 bp, Homo sapiens
  TCR 49 Codon-optimized/ cysteine-modified alpha
atgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgcgccgtgaatatcggcaccagcggcacctacaagtacatcttcggcaccggcaccagactgaaggtgctggct

SEQ ID NO: 1166 - DNA, 396 bp, Homo sapiens
  TCR 49 Codon-optimized/ cysteine-modified beta
atggatacctggctcgtgtgctgggccatcttcagcctgctgaaagccggactgaccgagcctgaagtgacccagacacctagccaccaagtgacacagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacaccccggtacagctacgagcagtatttcggccctggcaccagactgaccgtgaca

SEQ ID NO: 1167 - DNA, 396 bp, Homo sapiens
  TCR 50 Codon-optimized/ cysteine-modified alpha
atgaagaccttcgccggcttcagcttcctgttcctgtggctgcagctggactgcatgagcagaggcgaggatgtggaacagagcctgtttctgagcgtccgcgagggcgatagcagcgtgatcaattgcacctacaccgacagcagcagcacctacctgtactggtacaagcaagagcctggcgccggactgcagctgctgacctacatcttcagcaacatggacatgaagcaggaccagcggctgaccgtgctgctgaacaagaaggacaagcacctgagcctgcggatcgccgatacacagacaggcgacagcgccatctacttttgcgccgagtctcctccaggcacctacaagtacatcttcggcaccggcaccagactgaaggtgctggct

SEQ ID NO: 1168 - DNA, 396 bp, Homo sapiens
  TCR 50 Codon-optimized/ cysteine-modified beta
atgggcttcagactgctgtgctgcgtggccttttgtctgcttggagccggacctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccactactacaacggcgaggaaagagccaagggcaacatcctggaacggttcagcgcccagcagttcccagatctgcacagcgagctgaacctgagcagcctggaactgggagatagcgccctgtacttctgtgccagcagcgccacaagagatgcctacggctacacatttggcagcggcaccagactgacagtggtg

SEQ ID NO: 1169 - DNA, 408 bp, Homo sapiens
  TCR 51 Codon-optimized/ cysteine-modified alpha
atgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgagcatctacagcaacggcgacaaagaggacggccggtttacagcccagctgaacaaggccagccagtacgtgtccctgctgatcagagatagccagcctagcgacagcgccacctatctgtgcgccgtgaatatgagaggcggcggaagcaactacaagctgacctttggcaagggcaccctgctgaccgtgaatccc

SEQ ID NO: 1170 - DNA, 396 bp, Homo sapiens
  TCR 51 Codon-optimized/ cysteine-modified beta
atggatacctggctcgtgtgctgggccatcttcagcctgctgaaagccggactgaccgagcctgaagtgacccagacacctagccaccaagtgacacagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccattgccagccgggtgtcctacgagcagtatttcggccctggcaccagactgaccgtgaca

SEQ ID NO: 1171 - DNA, 381 bp, Homo sapiens
  TCR 52 Codon-optimized/ cysteine-modified alpha
atggtgctgaagttcagcgtgtccatcctgtggatccagctggcctgggtttccacacagctgctggaacagagccctcagttcctgagcatccaagagggcgagaacctgaccgtgtactgcaacagcagcagcgtgttcagcagcctgcagtggtacagacaagagcctggcgaaggacctgtgctgctggtcacagttgtgacaggcggcgaagtgaagaagctgaagcggctgaccttccagttcggcgacgccagaaaggatagctccctgcacattaccgctgctcagccaggcgataccggcctgtatctttgtgccggcgctcgggattacaagctgtcttttggcgccggaaccaccgtgacagtgcgggct

SEQ ID NO: 1172 - DNA, 396 bp, Homo sapiens
  TCR 52 Codon-optimized/ cysteine-modified beta
atgggcttcagactgctgtgctgcgtggccttttgtctgcttggagccggacctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagctctgtgggcgatctgaacaacgagcagttcttcggccctggcaccagactgacagttctg

SEQ ID NO: 1173 - DNA, 402 bp, Homo sapiens
  TCR 53 Codon-optimized/ cysteine-modified alpha
atggccagcgctcctatctctatgctggccatgctgttcaccctgagcggactgagagcacagtctgtggcccagcctgaggaccaagtgaatgtggccgagggcaatcccctgaccgtgaagtgtacctacagcgtgtccggcaatccctacctgttttggtacgtgcagtaccccaaccggggcctgcagttcctgctgaagtacatcaccggcgacaacctggtcaagggcagctatggattcgaggccgagttcaacaagagccagaccagcttccacctgaagaaacccagcgctctggtgtccgatagcgccctgtatttctgcgccgtcagagattttggcagcggcacctacaagtacatcttcggcaccggcaccagactgaaggtgctggct

SEQ ID NO: 1174 - DNA, 404 bp, Homo sapiens
  TCR 53 Codon-optimized/ cysteine-modified beta
atgggcacaagcctgctgtgttgggtcgtgctgggctttctgggcacagatcatacaggcgccggtgtcagccagtctcctcggtacaaagtgaccaagcgcggacaggatgtggccctgagatgcgatcctatctctggccacgtgtccctgtactggtacagacaggctctcggacagggccccgagttcctgacctacttcaattacgaggcccagcaggacaagagcggcctgcctaacgatagattcagcgccgaaagacccgagggcagcatcagcacactgaccatccagagaaccgagcagagggacagcgccatgtacagatgtgcctctagcggcagcggcaccagcggctacaatgagcagtttttcggccctggcaccagactgacagtgct

SEQ ID NO: 1175 - DNA, 402 bp, Homo sapiens
  TCR 54 Codon-optimized/ cysteine-modified alpha
atgaagaagcacctgaccacctttctggtcatcctgtggctgtacttctacagaggcaacggcaagaaccaggtggaacagagccctcagagcctgatcatcctggaaggcaagaactgcaccctgcagtgcaactacaccgtgtctcccttcagcaacctgcggtggtacaagcaggatacaggcagaggccctgtgtctctgaccatcatgaccttcagcgagaacaccaagagcaacggcagatacaccgccacactggacgccgatacaaagcagagcagcctgcacatcacagccagccagctgagcgatagcgccagctacatctgcgtggtgtccagagacaactacggccagaacttcgtgttcggccctggcacaagactgagcgtgctgcct

SEQ ID NO: 1176 - DNA, 396 bp, Homo sapiens
  TCR 54 Codon-optimized/ cysteine-modified beta
atggatacttggctcgtgtgctgggccatcttcagcctgctgaaagccggactgaccgagcctgaagtgacacagacacctagccaccaagtgacccagatgggccaagaggtcatactgagatgcgtgcccatcagcaaccacctgtacttctactggtacagacagatcctgggccagaaggtggaattcctcgtcagcttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatcaccgaccggaccaactacggctacacatttggcagcggcaccagactgacagtggtc

SEQ ID NO: 1177 - DNA, 396 bp, Homo sapiens
  TCR 55 Codon-optimized/ cysteine-modified alpha
atgaagaccttcgccggcttcagcttcctgttcctgtggctgcagctggactgtatgagcagaggcgaggatgtggaacagagcctgtttctgagcgtcagagaaggcgacagcagcgtgatcaactgcacctacaccgacagctccagcacctacctgtactggtacaagcaagaacctggcgccggactgcagctgctgacctacatcttcagcaacatggacatgaagcaggaccagcggctgaccgtgctgctgaacaagaaggataagcacctgagcctgcggatcgccgatacacagacaggcgactccgccatctacttttgtgctgtgcctagcggcgccaccaacaagctgatctttggaacaggcacactgctggccgtgcagccc

SEQ ID NO: 1178 - DNA, 396 bp, Homo sapiens
  TCR 55 Codon-optimized/ cysteine-modified beta
atggatacttggctcgtgtgctgggccatcttcagcctgctgaaagccggactgaccgagcctgaagtgacacagacacctagccaccaagtgacccagatgggccaagaggtcatactgagatgcgtgcccatcagcaaccacctgtacttctactggtacagacagatcctgggccagaaggtggaattcctcgtcagcttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaccaccagaagcagctacgagcagtatttcggccctggcaccagactgaccgtgaca

SEQ ID NO: 1179 - DNA, 66 bp, Artificial Sequence
  TCR 15/ TCR 16/ TCR 17/ TCR 18/ TCR 19/  TCR 20/ TCR 21/ TCR22/ TCR 23/ TCR 24/ TCR 25/ TCR 26/ TCR 27/ TCR 28/ TCR 29/ TCR 30/ TCR 31/ TCR 32/ TCR 33/ TCR 34 P2A
ggctctggcgccaccaactttagcctgctgaagcaggccggcgatgtggaggagaatcctggccca

SEQ ID NO: 1180 - DNA, 66 bp, Artificial Sequence
  TCR 35/ TCR 36/ TCR 38/ TCR 40/ TCR 41/ TCR 42/ TCR 43/ TCR 44/ TCR 45/ TCR 46/ TCR 47/ TCR 48 P2A
ggaagcggcgccacaaacttctcactgctgaaacaggctggcgacgtggaggagaatcctggccca

SEQ ID NO: 1181 - DNA, 66 bp, Artificial Sequence
  TCR 37/ TCR 39 P2A
ggcagcggcgccaccaacttcagcctgcttaaacaagctggcgacgtggaggagaatcctggccca

SEQ ID NO: 1182 - DNA, 20 bp, Homo sapiens
  TRAC target sequence
attcaccgattttgattctc

SEQ ID NO: 1183 - protein, 14 aa, Artificial Sequence
  TCR alpha E7(11-19) CDR3 consensus
  VARIANT (1)...(1): X1 is V or A
  VARIANT (2)...(2): X2 is V, A, G, Q, M, or E
  VARIANT (3)...(3): X3 is  S, G, A, N,Y, R,T, or P
  VARIANT (4)...(4): X4 is E, A, S, G, R. F, N, D, V, P, L, I, or M
  VARIANT (5)...(5): X5 is R, N, H, T, D, G, S, A, P, L, Q, or F
  VARIANT (6)...(6): X6 is G, H, N, A, S, L, T, or null
  VARIANT (7)...(7): X7 is T, S, G, or null
  VARIANT (8)...(8): X8 is G or null
  VARIANT (9)...(9): X9 is G, Y, N, S, or null
  VARIANT (10)...(10): X10 is T, G, S, D, F, Y, A, N, or null
  VARIANT (11)...(11): X11 is Y, F, Y, Q, N, or R
  VARIANT (12)...(12): X12 is N, K, Q, or D
  VARIANT (13)...(13): X13 is Y, L, T, F, M, or V
  VARIANT (14)...(14): X14 is I, T, S, V, R, or Y
XXXXXXXXXXXXXX

SEQ ID NO: 1184 - protein, 13 aa, Artificial Sequence
  TCR alpha E7(11-19) CDR3 consensus
  VARIANT (3)...(3): X3 is S, N, or T
  VARIANT (4)...(4): X4 is R or F
  VARIANT (5)...(5): X5 is D or A
  VARIANT (6)...(6): X6 is N or L
  VARIANT (7)...(7): X7is T or null
  VARIANT (8)...(8): X8 is Y or G
  VARIANT (10)...(10): X10 is Q or F
  VARIANT (11)...(11): X11 is N or K
  VARIANT (12)...(12): X12 is F or T
  VARIANT (13)...(13): X13 is V or I
VVXXXXXXGXXXX

SEQ ID NO: 1185 - protein, 14 aa, Artificial Sequence
  TCR alpha E7(11-19) CDR3 consensus
  VARIANT (2)...(2): X2 is A, G, V, Q, M, or E
  VARIANT (3)...(3): X3 is  S, G, N, A, Y, R, or P
  VARIANT (4)...(4): X4 is E, S, A, G, F, N, D, V, P, L, I, M, or R
  VARIANT (5)...(5): X5 is R, N, H, T, D, G, S, P, L, Q, or F
  VARIANT (6)...(6): X6 is G, H, A, S, T, or null
  VARIANT (7)...(7): X7 is T, S, G, or null
  VARIANT (8)...(8): X8 is G or null
  VARIANT (9)...(9): X9 is G, N, S, or null
  VARIANT (10)...(10): X10 is T, G, S, D, F, Y, A, or N
  VARIANT (11)...(11): X11 is Y, F, Q, R, or N
  VARIANT (12)...(12): X12 is K, Q, or D
  VARIANT (13)...(13): X13 is Y, L, T, M, F, or V
  VARIANT (14)...(14): X14is I, T, S, R, Y, or V
AXXXXXXXXXXXXX

SEQ ID NO: 1186 - protein, 13 aa, Artificial Sequence
  TCR alpha E7(11-19) CDR3 consensus
  VARIANT (1)...(1): X1 is A or V
  VARIANT (2)...(2): X2 is A, V, or E
  VARIANT (3)...(3): X3 is  S, N, T, R, or P
  VARIANT (4)...(4): X4 is E, A, G, F, V, P, I, D, or S
  VARIANT (5)...(5): X5 is R, H, T, A P, S, G, or F
  VARIANT (6)...(6): X6 is G, H, L, T, S, A, or null
  VARIANT (7)...(7): X7 is S, T, or null
  VARIANT (8)...(8): X8 is G or null
  VARIANT (9)...(9): X9 is G, T, or null
  VARIANT (10)...(10): X10 is F, Y, or N
  VARIANT (12)...(12): X12 is Y, T, L
XXXXXXXXXXKXI

SEQ ID NO: 1187 - protein, 13 aa, Artificial Sequence
  TCR alpha E7(11-19) CDR3 consensus
  VARIANT (2)...(2): X2 is A, V, or E
  VARIANT (3)...(3): X3 is  S, N, or R
  VARIANT (4)...(4): X4 is E, G, V, P, I, or D
  VARIANT (5)...(5): X5 is R, T, P, S, G, or F
  VARIANT (6)...(6): X6 is G, T, S, or null
  VARIANT (7)...(7): X7is S or null
  VARIANT (8)...(8): X8 is G or null
  VARIANT (9)...(9): X9 is T or null
AXXXXXXXXYKYI

SEQ ID NO: 1188 - protein, 14 aa, Artificial Sequence
  TCR alpha E7(11-19) CDR3 consensus
  VARIANT (2)...(2): X2 is G, V, Q, or M
  VARIANT (3)...(3): X3 is  G, A, Y, S, N, or R
  VARIANT (4)...(4): X4 is S, G, L, I, M, or R
  VARIANT (5)...(5): X5 is N, D, G, S, L, Q, or R
  VARIANT (6)...(6): X6 is A, S, G, or null
  VARIANT (7)...(7): X7 is G or null
  VARIANT (8)...(8): X8 is G or null
  VARIANT (9)...(9): X9 is G, N, S, or null
  VARIANT (10)...(10): X10 is S, D, Y, A, N, or null
  VARIANT (11)...(11): X11 is Y, Q, or R
  VARIANT (12)...(12): X12 is K or Q
  VARIANT (13)...(13): X13 is L or V
  VARIANT (14)...(14): X14 is S, T, or V
AXXXXXXXXXXXXX

SEQ ID NO: 1189 - protein, 14 aa, Artificial Sequence
  TCR alpha E7(11-19) CDR3 consensus
  VARIANT (2)...(2): X2 is G, V, or Q
  VARIANT (3)...(3): X3 is  G, Y, S, or N
  VARIANT (4)...(4): X4 is S,  L,  or M
  VARIANT (5)...(5): X5 is N, G, L, or R
  VARIANT (6)...(6): X6 is A, S, G, or null
  VARIANT (7)...(7): X7 is G or null
  VARIANT (8)...(8): X8 is G or null
  VARIANT (9)...(9): X9 is G, S or null
  VARIANT (10)...(10): X10 is S, Y, A, N, or null
  VARIANT (11)...(11): X11 is Y, Q, or R
  VARIANT (12)...(12): X12 is K or Q
  VARIANT (13)...(13): X13 is L or V
AXXXXXXXXXXXXT

SEQ ID NO: 1190 - protein, 11 aa, Artificial Sequence
  TCR alpha E7(11-19) CDR3 consensus
  VARIANT (2)...(2): X2 is G or V
  VARIANT (3)...(3): X3 is  A or Y
  VARIANT (4)...(4): X4 is G, S, or R
  VARIANT (5)...(5): X5 is D, or S
  VARIANT (6)...(6): X6 is N, or null
  VARIANT (7)...(7): X7 is D or null
AXXXXXXYKLS

SEQ ID NO: 1191 - protein, 6 aa, Artificial Sequence
  TCR alpha E7(11-19) CDR1 consensus
  VARIANT (1)...(1): X1 is N, S, D, T, or V
  VARIANT (2)...(2): X2 is S, V, R, T, or I
  VARIANT (3)...(3): X3 is  M, F, G, S, N, A, L, V, or P
  VARIANT (4)...(4): X4 is F, S, N, A, or null
  VARIANT (5)...(5): X5 is D, S, Q, Y, N, V, T, or P
  VARIANT (6)...(6): X6 is Y, S, R, N, G, or T
XXXXXX

SEQ ID NO: 1192 - protein, 8 aa, Artificial Sequence
  TCR alpha E7(11-19) CDR2 consensus
  VARIANT (1)...(1): X1 is I, V, L, G, , N, T, Y, or M
  VARIANT (2)...(2): X2 is S, V, Y, L, P, F, I, or T
  VARIANT (3)...(3): X3 is  S, Y, K, L, T, or F
  VARIANT (4)...(4): X4 is I, G, N, A, S, or null
  VARIANT (5)...(5): X5 is S, D, or null
  VARIANT (6)...(6): X6 is K, G, N, S, D, T, or E
  VARIANT (7)...(7): X7 is D, E, G, A, K, L, or N
  VARIANT (8)...(8): X8 is K, V, D, P, N, T, L, or M
XXXXXXXX

SEQ ID NO: 1193 - protein, 14 aa, Artificial Sequence
  TCR beta E7(11-19) CDR3 consensus
  VARIANT (2)...(2): X2 is S, M, I, K, or V
  VARIANT (3)...(3): X3 is  S, T, N, or A
  VARIANT (4)...(4): X4 is R, V P, S, T, G, L, A, I, or D
  VARIANT (5)...(5): X5 is F, G, R, Y, S, L, V, or T
  VARIANT (6)...(6): X6 is L, G, D, A, S, T, V, R, or null
  VARIANT (7)...(7): X7is G, D, R, S, T, or null
  VARIANT (8)...(8): X8 is S or null
  VARIANT (9)...(9): X9 is S, H, G, R, V, T, D, L, or null
  VARIANT (10)...(10): X10 is T, S, A, Y, N, G, or P
  VARIANT (11)...(11): X11 is D,Y, N, E, K, or G
  VARIANT (12)...(12): X12 is T, E, G, or K
  VARIANT (13)...(13): X13 is Q, Y, A, or L
  VARIANT (14)...(14): X14is Y, F, T, or I
AXXXXXXXXXXXXX

SEQ ID NO: 1194 - protein, 12 aa, Artificial Sequence
  TCR beta E7(11-19) CDR3 consensus
  VARIANT (2)...(2): X2 is S, M, I, or K
  VARIANT (4)...(4): X4 is P, T, G, A, S, or D
  VARIANT (5)...(5): X5 is R or S
  VARIANT (6)...(6): X6 is D, G, S, T, or V
  VARIANT (7)...(7): X7 is R, S, or null
  VARIANT (8)...(8): X8 is T, Y, G, N, or S
  VARIANT (9)...(9): X9 isY, N, or K
  VARIANT (10)...(10): X10 is E or G
  VARIANT (11)...(11): X11 is Q, A, or Y
  VARIANT (12)...(12): X12 is Y, F, or T
AXTXXXXXXXXX

SEQ ID NO: 1195 - protein, 14 aa, Artificial Sequence
  TCR beta E7(11-19) CDR3 consensus
  VARIANT (2)...(2): X2 is S, M, I, or K
  VARIANT (3)...(3): X3 is  S, T, A, or N
  VARIANT (4)...(4): X4 is R, V, S, P, T, G, L, or A
  VARIANT (5)...(5): X5 is F, G, R, Y, S, V, or T
  VARIANT (6)...(6): X6 is L, G, D, A, S, T, V, or null
  VARIANT (7)...(7): X7 is G, D, R, T, or null
  VARIANT (8)...(8): X8 is S or null
  VARIANT (9)...(9): X9 is S, H, G, R, V, T, L, or null
  VARIANT (10)...(10): X10 is T, S, Y, A, N, G, or P
  VARIANT (11)...(11): X11 is D, Y, N, K, E, or G
  VARIANT (12)...(12): X12 is T or E
  VARIANT (13)...(13): X13 is Q, A, or L
  VARIANT (14)...(14): X14 is Y or F
AXXXXXXXXXXXXX

SEQ ID NO: 1196 - protein, 13 aa, Artificial Sequence
  TCR beta E7(11-19) CDR3 consensus
  VARIANT (2)...(2): X2 is S, M, I, or K
  VARIANT (3)...(3): X3 is  S, T, A, or N
  VARIANT (4)...(4): X4 is R, P, S, G, L, A, or T
  VARIANT (5)...(5): X5 is F, R, Y, V, or T
  VARIANT (6)...(6): X6 is L, D, A, S, T, V, or null
  VARIANT (7)...(7): X7 is G, R, or null
  VARIANT (8)...(8): X8 is S, G, V, or null
  VARIANT (9)...(9): X9 is T, A, G, N, S, or P
  VARIANT (10)...(10): X10 is D, Y, or E
  VARIANT (11)...(11): X11 is T or E
AXXXXXXXXXXQY

SEQ ID NO: 1197 - protein, 13 aa, Artificial Sequence
  TCR beta E7(11-19) CDR3 consensus
  VARIANT (2)...(2): X2 is S, M, I, or K
  VARIANT (3)...(3): X3 is  S, T, A, or N
  VARIANT (4)...(4): X4 is P, S, G, T,  or A
  VARIANT (5)...(5): X5 is  R or Y
  VARIANT (6)...(6): X6 is D, A, S, T, or V
  VARIANT (7)...(7): X7 is R or null
  VARIANT (8)...(8): X8 is G, V, or null
  VARIANT (9)...(9): X9 is S, T, A, or N
AXXXXXXXXYEQY

SEQ ID NO: 1198 - protein, 14 aa, Artificial Sequence
  TCR beta E7(11-19) CDR3 consensus
  VARIANT (4)...(4): X4 is T, P, or G
  VARIANT (5)...(5): X5 is R or S
  VARIANT (6)...(6): X6 is S, D, G, or V
  VARIANT (7)...(7): X7 is D or null
  VARIANT (8)...(8): X8 is S or null
  VARIANT (9)...(9): X9 is S, R, or null
  VARIANT (10)...(10): X10 is S, T, Y, or G
  VARIANT (11)...(11): X11 is Y, N, or K
  VARIANT (13)...(13): X13 is Q or A
  VARIANT (14)...(14): X14 is Y or F
ASTXXXXXXXXEXX

SEQ ID NO: 1199 - protein, 12 aa, Artificial Sequence
  TCR beta E7(11-19) CDR3 consensus
  VARIANT (2)...(2): X2 is S or I
  VARIANT (3)...(3): X3 is  S or T
  VARIANT (4)...(4): X4 is L, A, or D
  VARIANT (5)...(5): X5 is L, T, or R
  VARIANT (6)...(6): X6 is L, T, or R
  VARIANT (7)...(7): X7 is G, D, or null
  VARIANT (8)...(8): X8 is A or N
AXXXXXXXYGYT

SEQ ID NO: 1200 - protein, 14 aa, Artificial Sequence
  TCR beta E7(11-19) CDR3 consensus
  VARIANT (2)...(2): X2 is S, V, or I
  VARIANT (3)...(3): X3 is  S, N, or A
  VARIANT (4)...(4): X4 is R, V, S, L, P, G, I, or A
  VARIANT (5)...(5): X5 is F, G, Y, L, V, R, T, or S
  VARIANT (6)...(6): X6 is L, G, A, D, R, V, or null
  VARIANT (7)...(7): X7 is G, D, R, S, T, or null
  VARIANT (8)...(8): X8 is S or null
  VARIANT (9)...(9): X9 is S, H, G, V, T, D, L, or null
  VARIANT (10)...(10): X10 is T, S, A, G, P, N, or Y
  VARIANT (11)...(11): X11 is D, Y, E, G, or N
  VARIANT (12)...(12): X12 is T, E, G, or K
  VARIANT (13)...(13): X13 is Q, Y, or L
  VARIANT (14)...(14): X14 is Y, F, T, or I
AXXXXXXXXXXXXX

SEQ ID NO: 1201 - protein, 14 aa, Artificial Sequence
  TCR beta E7(11-19) CDR3 consensus
  VARIANT (4)...(4): X4 is R, V, S, L, G, or A
  VARIANT (5)...(5): X5 is F, G, Y, L, V, T, or S
  VARIANT (6)...(6): X6 is A, L, R, D, G, or null
  VARIANT (7)...(7): X7 is G, D, T, or null
  VARIANT (8)...(8): X8 is S or null
  VARIANT (9)...(9): X9 is S, H, G, T, D, L, or null
  VARIANT (10)...(10): X10 is T, S, A, G, P, N, or Y
  VARIANT (11)...(11): X11 is D, Y, E, G, or N
  VARIANT (12)...(12): X12 isT, E, G, or T
  VARIANT (13)...(13): X13 is Q, Y, or L
  VARIANT (14)...(14): X14 isY, F, or T
ASSXXXXXXXXXXX

SEQ ID NO: 1202 - protein, 13 aa, Artificial Sequence
  TCR beta E7(11-19) CDR3 consensus
  VARIANT (4)...(4): X4 is R, L, or G
  VARIANT (5)...(5): X5 is F, V, T, or Y
  VARIANT (6)...(6): X6 is L, A, or null
  VARIANT (7)...(7): X7 is G, or null
  VARIANT (8)...(8): X8 is S, G, or null
  VARIANT (9)...(9): X9 is T, G, P, or S
  VARIANT (10)...(10): X10 is D or E
ASSXXXXXXXTQY

SEQ ID NO: 1203 - protein, 5 aa, Artificial Sequence
  TCR beta E7(11-19) CDR1 consensus
  VARIANT (2)...(2): X2 is G or N
  VARIANT (3)...(3): X3 is  H or D
  VARIANT (4)...(4): X4 isT, L, N, or V
  VARIANT (5)...(5): X5 is A, S, Y, or T
SXXXX

SEQ ID NO: 1204 - protein, 6 aa, Artificial Sequence
  TCR beta E7(11-19) CDR2 consensus
  VARIANT (1)...(1): X1 is F or Y
  VARIANT (2)...(2): X2 is Q, Y, or N
  VARIANT (3)...(3): X3 is  G, N, R, or Y
  VARIANT (4)...(4): X4 is N, G, E, or T
  VARIANT (5)...(5): X5 is S, E, A, or G
  VARIANT (6)...(6): X6 is A, E, I, or Q
XXXXXX

SEQ ID NO: 1205 - protein, 18 aa, Artificial Sequence
  TCR alpha E6(29-38) CDR3 consensus
  VARIANT (1)...(1): X1 is A, I, or V
  VARIANT (2)...(2): X2 is M, L, A, V, S, or E
  VARIANT (3)...(3): X3 is  R, L, N, S, Q, K, G, or W
  VARIANT (4)...(4): X4 is E, V, P, T, F, A, G, N, D, or L
  VARIANT (5)...(5): X5 is G, I, D, L, A, P, H, N, R, T, or null
  VARIANT (6)...(6): X6 is G, N, R, T, M, S, P, or null
  VARIANT (7)...(7): X7 is G, V, D, L, Q, T, R, N, or null
  VARIANT (8)...(8): X8 is T, D, S, L, G, or null
  VARIANT (9)...(9): X9 is A, G, Q, or null
  VARIANT (10)...(10): X10 is G, or null
  VARIANT (11)...(11): X11 is G or null
  VARIANT (12)...(12): X12 is T or null
  VARIANT (13)...(13): X13 is S, A, T, G, or null
  VARIANT (14)...(14): X14 is G, Y, T, N, A, W, or null
  VARIANT (15)...(15): X15 is F, G, N, T, Y, D, S, R, Q, or E
  VARIANT (16)...(16): X16 is K, P, A, N, D, or Q
  VARIANT (17)...(18): X17 is L, M, I, V, or T X18 is I, T, V, N, F, R, or Q
XXXXXXXXXXXXXXXXXX

SEQ ID NO: 1206 - protein, 18 aa, Artificial Sequence
  TCR alpha E6(29-38) CDR3 consensus
  VARIANT (1)...(1): X1 is A, I, or V
  VARIANT (2)...(2): X2 is L, M, V, or E
  VARIANT (3)...(3): X3 is  L, R, N, G, or S
  VARIANT (4)...(4): X4 is V, T, F, N, E, P, G, or L
  VARIANT (5)...(5): X5 is I, A, P, N, G, or T
  VARIANT (6)...(6): X6 is R, G, S, or T
  VARIANT (7)...(7): X7 is G, R, L, V, or T
  VARIANT (8)...(8): X8 is T, G, L, or null
  VARIANT (9)...(9): X9 is A, G, Q, or null
  VARIANT (10)...(10): X10 is G, or null
  VARIANT (11)...(11): X11 is G, or null
  VARIANT (12)...(12): X12 is T or null
  VARIANT (13)...(13): X13 is S, T, or G
  VARIANT (14)...(14): X14 is Y, A, G, or N
  VARIANT (15)...(15): X15 is G, S, N, R, or E
  VARIANT (16)...(16): X16 is K or Q
XXXXXXXXXXXXXXXXLT

SEQ ID NO: 1207 - protein, 15 aa, Artificial Sequence
  TCR alpha E6(29-38) CDR3 consensus
  VARIANT (4)...(4): X4 is E, T, A, D, or L
  VARIANT (5)...(5): X5 is G, A, N, or R
  VARIANT (6)...(6): X6 is R, G, R, T, M, or S
  VARIANT (7)...(7): X7 is G, V, D, L, or null
  VARIANT (8)...(8): X8 is T, D, or null
  VARIANT (9)...(9): X9 is G or null
  VARIANT (10)...(10): X10 is S, T, G, or null
  VARIANT (11)...(11): X11 is G, Y, N, A, or W
  VARIANT (12)...(12): X12 is F, G, N, D, S, or Y
  VARIANT (13)...(13): X13 is K, D,or Q
  VARIANT (14)...(14): X14 is T, L, M, or I
  VARIANT (15)...(15): X15 is I, T, R, or Q
AMRXXXXXXXXXXXX

SEQ ID NO: 1208 - protein, 18 aa, Artificial Sequence
  TCR alpha E6(29-38) CDR3 consensus
  VARIANT (1)...(1): X1 is I or V
  VARIANT (2)...(2): X2 is L or V
  VARIANT (3)...(3): X3 is  L, N, or R
  VARIANT (4)...(4): X4 is V, F, or G
  VARIANT (5)...(5): X5 is I, P, G, or T
  VARIANT (6)...(6): X6 is R, S, P, or G
  VARIANT (7)...(7): X7 is G, R, Q, T, or V
  VARIANT (8)...(8): X8 is T, G, S, or L
  VARIANT (9)...(9): X9 is A, G, Q, or null
  VARIANT (10)...(10): X10 is G or null
  VARIANT (11)...(11): X11 is G or null
  VARIANT (12)...(12): X12 is T or null
  VARIANT (13)...(13): X13 is G or S
  VARIANT (14)...(14): X14 is Y or N
  VARIANT (15)...(15): X15 is G, Q, or E
  VARIANT (17)...(17): X17 is V or L
  VARIANT (18)...(18): X18 is I or T
XXXXXXXXXXXXXXXKXX

SEQ ID NO: 1209 - protein, 7 aa, Artificial Sequence
  TCR alpha E6(29-38) CDR1consensus
  VARIANT (1)...(1): X1 is T, N, D, or S
  VARIANT (2)...(2): X2 is S, I, or R
  VARIANT (3)...(3): X3 is  D, S, M, A, Y, N, or G
  VARIANT (4)...(4): X4 is Q, G, P, or null
  VARIANT (5)...(5): X5 is S, T, F, I, or N
  VARIANT (6)...(6): X6 is Y, D, Q, P, N, or E
  VARIANT (7)...(7): X7 is G, Y, N, S, or A
XXXXXXX

SEQ ID NO: 1210 - protein, 8 aa, Artificial Sequence
  TCR alpha E6(29-38) CDR2consensus
  VARIANT (0)...(0)
  VARIANT (1)...(1): X1 is Q, G, I, V, Y, M, R, or N
  VARIANT (2)...(2): X2 is G, L, S, Q, Y, T, N, or V
  VARIANT (3)...(3): X3 is  S, T, L, or K
  VARIANT (4)...(4): X4 is Y, I, S, A, N, F, or null
  VARIANT (5)...(5): X5 is D, A, or null
  VARIANT (6)...(6): X6 is E, K, Q, S, T, G, D, or null
  VARIANT (7)...(7): X7 is Q, S, N, R, G, L, or D
  VARIANT (8)...(8): X8 is N, K, E, V, or L
XXXXXXXX

SEQ ID NO: 1211 - protein, 15 aa, Artificial Sequence
  TCR beta E6(29-38) CDR3 consensus
  VARIANT (1)...(1): X1 is A, S, or V
  VARIANT (2)...(2): X2 is S, A, or V
  VARIANT (3)...(3): X3 is  S, V, R, or Q
  VARIANT (4)...(4): X4 is H, P, Q, L, Y, G, T, F, S, R, or E
  VARIANT (5)...(5): X5 is L, G, R, W, F, S, V, T, Y, Q, or null
  VARIANT (6)...(6): X6 is A, G, L, T, E, P, or null
  VARIANT (7)...(7): X7 is G, T, A, R, Q, N, S, or null
  VARIANT (8)...(8): X8 is G, S, or null
  VARIANT (9)...(9): X9 is G or null
  VARIANT (10)...(10): X10 is F, G, A, S, T, R, Q, L, or null
  VARIANT (11)...(11): X11 is T, N, F, A, R, S, G, or null
  VARIANT (12)...(12): X12 is G, T, L D, Y, N, Q, S, or E
  VARIANT (13)...(13): X13 is E, W, T,G,  K, N, or P
  VARIANT (14)...(14): X14 is L, A, K, Q, Y, or I
  VARIANT (15)...(15): X15 is F, H, Y, T, or I
XXXXXXXXXXXXXXX

SEQ ID NO: 1212 - protein, 14 aa, Artificial Sequence
  TCR beta E6(29-38) CDR3 consensus
  VARIANT (4)...(4): X4 is H, P, Q, L, Y, F, R, or E
  VARIANT (5)...(5): X5 is L, G, R, W, F, S, V, T, Y, or Q
  VARIANT (6)...(6): X6 is A, G, L, E or P
  VARIANT (7)...(7): X7 is G, T, A, R, Q, S, or null
  VARIANT (8)...(8): X8 is G, S, or null
  VARIANT (9)...(9): X9 is F, G, A, S, T,R, L, or null
  VARIANT (10)...(10): X10 is T, N, A, F, R, S, or G
  VARIANT (11)...(11): X11 is G, T, L, D, Y, Q, S, E, or N
  VARIANT (12)...(12): X12 is E, W, T, G, P,  or K
  VARIANT (13)...(13): X13 is L, A, K, Q, Y, or I
  VARIANT (14)...(14): X14  is F, H, Y, or T
ASSXXXXXXXXXXX

SEQ ID NO: 1213 - protein, 15 aa, Artificial Sequence
  TCR beta E6(29-38) CDR3 consensus
  VARIANT (1)...(1): X1 is A or S
  VARIANT (2)...(2): X2 is S, V, or A
  VARIANT (3)...(3): X3 is  S or V
  VARIANT (4)...(4): X4 is L, Y, P, or S
  VARIANT (5)...(5): X5 is W, F, V, L, or Y
  VARIANT (6)...(6): X6 is G, T, or A
  VARIANT (7)...(7): X7 is A, R, Q, S, or null
  VARIANT (8)...(8): X8 is G or null
  VARIANT (9)...(9): X9 is G or null
  VARIANT (10)...(10): X10 is S, T, R, or G
  VARIANT (11)...(11): X11 is T, A, R, S, or N
  VARIANT (12)...(12): X12 is D, Y, T, or G
  VARIANT (13)...(13): X13 is T or E
XXXXXXXXXXXXXQY

SEQ ID NO: 1214 - protein, 13 aa, Artificial Sequence
  TCR beta E6(29-38) CDR3 consensus
  VARIANT (3)...(3): X3 is S, Q, or R
  VARIANT (4)...(4): X4 is H, P, T, or E
  VARIANT (5)...(5): X5 is L, G, W, or F
  VARIANT (6)...(6): X6 is A, G, or null
  VARIANT (7)...(7): X7 is G, N, S, R, or null
  VARIANT (8)...(8): X8 is F, G, Q, L, A, or null
  VARIANT (9)...(9): X9 is T, N, or A
  VARIANT (10)...(10): X10 is G, T, N, or E
  VARIANT (11)...(11): X11 is E, N, or K
  VARIANT (12)...(12): X12 is L, A, or Q
ASXXXXXXXXXXF

SEQ ID NO: 1215 - protein, 13 aa, Artificial Sequence
  TCR beta E6(29-38) CDR3 consensus
  VARIANT (4)...(4): X4 is L or R
  VARIANT (5)...(5): X5 is S or T
  VARIANT (6)...(6): X6 is G, T, or A
  VARIANT (7)...(7): X7 is T or null
  VARIANT (8)...(8): X8 is G or null
  VARIANT (11)...(11): X11 is G or null
ASSXXXXXNYXYT

SEQ ID NO: 1216 - protein, 13 aa, Artificial Sequence
  TCR beta E6(29-38) CDR3 consensus
  VARIANT (4)...(4): X4 is L, F, or P
  VARIANT (7)...(7): X7 is R or Q
  VARIANT (12)...(12): X12 is Q or L
ASSXWGXSNQPXH

SEQ ID NO: 1217 - protein, 14 aa, Artificial Sequence
  TCR beta E6(29-38) CDR3 consensus
  VARIANT (4)...(4): X4 is L or R
  VARIANT (5)...(5): X5 is W or Q
  VARIANT (6)...(6): X6 is G or P
  VARIANT (7)...(7): X7 is R or S
  VARIANT (8)...(8): X8 is S or null
ASSXXXXXSGNTIY

SEQ ID NO: 1218 - protein, 6 aa, Artificial Sequence
  TCR beta E6(29-38) CDR1 consensus
  VARIANT (1)...(1): X1 is S, M, D, or L
  VARIANT (2)...(2): X2 is G, E, D, N, Q, S, or F
  VARIANT (3)...(3): X3 is  H, V, Y, N, or Q
  VARIANT (4)...(4): X4 is A, S, F, or null
  VARIANT (5)...(5): X5 is W V, N, E, T, P, Y, K, D, or L
  VARIANT (6)...(6): X6 is S, R, A, N, Y, M, or T
XXXXXX

SEQ ID NO: 1219 - protein, 7 aa, Artificial Sequence
  TCR beta E6(29-38) CDR2 consensus
  VARIANT (1)...(1): X1 is F, Y, S, A or M
  VARIANT (2)...(2): X2 is N, Q, V, T, Y, or A
  VARIANT (3)...(3): X3 is N, D, E, S, G, I, F, Q, or L
  VARIANT (4)...(4): X4 is G, A, N, or null
  VARIANT (5)...(5): X5 is E, K, V, E, S, T, G, or N
  VARIANT (6)...(6): X6 is A, E, K, G, L, D, V, or N
  VARIANT (7)...(7): X7 is Q, M, T, A, V, E, P, D, or I
XXXXXXX

SEQ ID NO: 1220 - protein, 18 aa, Artificial Sequence
  TCR alpha E6(29-38) CDR3 consensus
  VARIANT (1)...(1): X1 is A, I, or V
  VARIANT (2)...(2): X2 is M, L, A, V, S, or E
  VARIANT (3)...(3): X3 is  R, L, N, S, Q, K, G, or W
  VARIANT (4)...(4): X4 is E, V, P, T, F, A, G, N, D, or L
  VARIANT (5)...(5): X5 is G, I, D, L, A, P, N, R, T, or null
  VARIANT (6)...(6): X6 is G, N, R, T, M, S, P, or null
  VARIANT (7)...(7): X7 is G, V, D, L, Q, T, R, or null
  VARIANT (8)...(8): X8 is T, D, S, L, G, or null
  VARIANT (9)...(9): X9 is A, G, Q, or null
  VARIANT (10)...(10): X10 is G or null
  VARIANT (11)...(11): X11 is G or null
  VARIANT (12)...(12): X12 is T or null
  VARIANT (13)...(13): X13 is S, A, T, G or null
  VARIANT (14)...(14): X14  is G, Y, T, N, A, W, or null
  VARIANT (15)...(15): X15  is F, G, N, T, Y, D, S, R, Q, or E
  VARIANT (16)...(16): X16 is K, P, A, D, or Q
  VARIANT (17)...(18): X17 is L, M, I, V, or T X18 is I, T, V, F, R, or Q
XXXXXXXXXXXXXXXXXX

SEQ ID NO: 1221 - protein, 11 aa, Artificial Sequence
  TCR alpha E6(296-38) CDR3 consensus
  VARIANT (2)...(2): X2 is V or M
  VARIANT (4)...(4): X4 is P or D
  VARIANT (6)...(6): X6 is N or R
AXRXAXNNDMR

SEQ ID NO: 1222 - protein, 15 aa, Artificial Sequence
  TCR alpha E6(29-38) CDR3 consensus
  VARIANT (1)...(1): X1 is A, S, or V
  VARIANT (2)...(2): X2 is S, A, or V
  VARIANT (3)...(3): X3 is  S, R, or Q
  VARIANT (4)...(4): X4 is H, P, Q, L, Y, G, T, F, S, R, or E
  VARIANT (5)...(5): X5 is L, G, R, W, F, S, V, T, Y, Q, or null
  VARIANT (6)...(6): X6 is A, G, L, E, P, or null
  VARIANT (7)...(7): X7 is G, T, A, R, Q, N, S, or null
  VARIANT (8)...(8): X8 is G, S, or null
  VARIANT (9)...(9): X9 is G or null
  VARIANT (10)...(10): X10 is F, G, A, S, T, R, Q, L, or null
  VARIANT (11)...(11): X11 is T, N, F, A, R, S, G, or null
  VARIANT (12)...(12): X12 is G, T, L D, Y, N, Q, S, or E
  VARIANT (13)...(13): X13 is E, W, T,G,  K, N, or P
  VARIANT (14)...(14): X14  is L, A, K, Q, Y, or I
  VARIANT (15)...(15): X15  is F, H, Y, T, or I
XXXXXXXXXXXXXXX

SEQ ID NO: 1223 - protein, 15 aa, Artificial Sequence
  TCR beta E6(29-38) CDR3 consensus
  VARIANT (1)...(1): X1 is A or S
  VARIANT (2)...(2): X2 is S or A
  VARIANT (4)...(4): X4 is L, Y, P, or S
  VARIANT (5)...(5): X5 is W, F, V, L, or Y
  VARIANT (6)...(6): X6 is G or A
  VARIANT (7)...(7): X7 is A, R, Q, S, or null
  VARIANT (8)...(8): X8 is G or null
  VARIANT (9)...(9): X9 is G or null
  VARIANT (10)...(10): X10 is S, T, R, or G
  VARIANT (11)...(11): X11 is T, A, R, S, or N
  VARIANT (12)...(12): X12 is D, Y, T, or G
  VARIANT (13)...(13): X13 is T or E
XXSXXXXXXXXXXQY

SEQ ID NO: 1224 - DNA, 450 bp, Homo sapiens
  TCR 31 - Beta Native
gacagtgatcctgatctggtaaagctcccatcctgccctgaccctgccatgggcaccaggctcctcttctgggtggccttctgtctcctgggggcagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagccgcttcctcggaagcacagatacgcagtattttggcccaggcacccggctgacagtgctc

SEQ ID NO: 1225 - DNA, 469 bp, Homo sapiens
  TCR 31 - Alpha Native
gagatttgcagctttctaggcaggagacaagacaatctgcatcttcacaggagggatggccatgctcctgggggcatcagtgctgattctgtggcttcagccagactgggtaaacagtcaacagaagaatgatgaccagcaagttaagcaaaattcaccatccctgagcgtccaggaaggaagaatttctattctgaactgtgactatactaacagcatgtttgattatttcctatggtacaaaaaataccctgctgaaggtcctacattcctgatatctataagttccattaaggataaaaatgaagatggaagattcactgtcttcttaaacaaaagtgccaagcacctctctctgcacattgtgccctcccagcctggagactctgcagtgtacttctgtgcagcaagcgaaagaggaacctacaaatacatctttggaacaggcaccaggctgaaggttttagca

SEQ ID NO: 1226 - DNA, 449 bp, Homo sapiens
  TCR 34  - Alpha Native
gggatagccctggccaactttcaaggctcctaaatctgagttttcagtgaactggacagaaaaaaaaaatgaagaagctactagcaatgattctgtggcttcaactagaccggttaagtggagagctgaaagtggaacaaaaccctctgttcctgagcatgcaggagggaaaaaactataccatctactgcaattattcaaccacttcagacagactgtattggtacaggcaggatcctgggaaaagtctggaatctctgtttgtgttgctatcaaatggagcagtgaagcaggagggacgattaatggcctcacttgataccaaagcccgtctcagcaccctccacatcacagctgccgtgcatgacctctctgccacctacttctgtgccgtgtcaggaacctacaaatacatctttggaacaggcaccaggctgaaggttttagca

SEQ ID NO: 1227 - DNA, 418 bp, Homo sapiens
  TCR 34 - Beta Native
gggctgcctgccccactgtgccatgggccctgggctcctctgctgggcgctgctttgtctcctgggagcaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcaggggaaacttccctcctagattctcaggtctccagttccctaattatagctctgagctgaatgtgaacgccttggagctggacgactcggccctgtatctctgtgccagcagctcgtatgccggaagctacgagcagtacttcgggccgggcaccaggctcacggtcaca

SEQ ID NO: 1228 - DNA, 432 bp, Homo sapiens
  TCR 55 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaacgaggagctcctacgagcagtacttcgggccgggcaccaggctcacggtcacagaggacctgaaaaac

SEQ ID NO: 1229 - RNA, 20 nt, Artificial Sequence
  TRAC-10
ucucucagcugguacacggc

SEQ ID NO: 1230 - RNA, 20 nt, Artificial Sequence
  TRAC-110
uggauuuagagucucucagc

SEQ ID NO: 1231 - RNA, 20 nt, Artificial Sequence
  TRAC-116
acacggcagggucaggguuc

SEQ ID NO: 1232 - RNA, 20 nt, Artificial Sequence
  TRAC-4
gcugguacacggcaggguca

SEQ ID NO: 1233 - RNA, 17 nt, Artificial Sequence
  TRAC-49
cucagcugguacacggc

SEQ ID NO: 1234 - RNA, 17 nt, Artificial Sequence
  TRAC-2
ugguacacggcaggguc

SEQ ID NO: 1235 - RNA, 17 nt, Artificial Sequence
  TRAC-30
gcuagacaugaggucua

SEQ ID NO: 1236 - RNA, 17 nt, Artificial Sequence
  TRAC-43
gucagauuuguugcucc

SEQ ID NO: 1237 - RNA, 17 nt, Artificial Sequence
  TRAC-23
ucagcugguacacggca

SEQ ID NO: 1238 - RNA, 17 nt, Artificial Sequence
  TRAC-34
gcagacagacuugucac

SEQ ID NO: 1239 - RNA, 17 nt, Artificial Sequence
  TRAC-25
gguacacggcaggguca

SEQ ID NO: 1240 - RNA, 20 nt, Artificial Sequence
  TRAC-128
cuucaagagcaacagugcug

SEQ ID NO: 1241 - RNA, 20 nt, Artificial Sequence
  TRAC-105
agagcaacagugcuguggcc

SEQ ID NO: 1242 - RNA, 20 nt, Artificial Sequence
  TRAC-106
aaagucagauuuguugcucc

SEQ ID NO: 1243 - RNA, 20 nt, Artificial Sequence
  TRAC-123
acaaaacugugcuagacaug

SEQ ID NO: 1244 - RNA, 17 nt, Artificial Sequence
  TRAC-64
aaacugugcuagacaug

SEQ ID NO: 1245 - RNA, 20 nt, Artificial Sequence
  TRAC-97
ugugcuagacaugaggucua

SEQ ID NO: 1246 - RNA, 22 nt, Artificial Sequence
  TRAC-148
ggcuggggaagaaggugucuuc

SEQ ID NO: 1247 - RNA, 21 nt, Artificial Sequence
  TRAC-147
gcuggggaagaaggugucuuc

SEQ ID NO: 1248 - RNA, 18 nt, Artificial Sequence
  TRAC-234
ggggaagaaggugucuuc

SEQ ID NO: 1249 - RNA, 22 nt, Artificial Sequence
  TRAC-167
guuuugucugugauauacacau

SEQ ID NO: 1250 - RNA, 24 nt, Artificial Sequence
  TRAC-177
ggcagacagacuugucacuggauu

SEQ ID NO: 1251 - RNA, 23 nt, Artificial Sequence
  TRAC-176
gcagacagacuugucacuggauu

SEQ ID NO: 1252 - RNA, 20 nt, Artificial Sequence
  TRAC-257
gacagacuugucacuggauu

SEQ ID NO: 1253 - RNA, 24 nt, Artificial Sequence
  TRAC-233
gugaauaggcagacagacuuguca

SEQ ID NO: 1254 - RNA, 22 nt, Artificial Sequence
  TRAC-231
gaauaggcagacagacuuguca

SEQ ID NO: 1255 - RNA, 22 nt, Artificial Sequence
  TRAC-163
gagucucucagcugguacacgg

SEQ ID NO: 1256 - RNA, 20 nt, Artificial Sequence
  TRAC-241
gucucucagcugguacacgg

SEQ ID NO: 1257 - RNA, 22 nt, Artificial Sequence
  TRAC-179
gguacacggcagggucaggguu

SEQ ID NO: 1258 - RNA, 21 nt, Artificial Sequence
  TRAC-178
guacacggcagggucaggguu

SEQ ID NO: 1259 - RNA, 20 nt, Artificial Sequence
  TRBC-40
cacccagaucgucagcgccg

SEQ ID NO: 1260 - RNA, 20 nt, Artificial Sequence
  TRBC-52
caaacacagcgaccucgggu

SEQ ID NO: 1261 - RNA, 20 nt, Artificial Sequence
  TRBC-25
ugacgaguggacccaggaua

SEQ ID NO: 1262 - RNA, 20 nt, Artificial Sequence
  TRBC-35
ggcucucggagaaugacgag

SEQ ID NO: 1263 - RNA, 20 nt, Artificial Sequence
  TRBC-39
gaaaaacguguucccacccg

SEQ ID NO: 1264 - RNA, 20 nt, Artificial Sequence
  TRBC-49
augacgaguggacccaggau

SEQ ID NO: 1265 - RNA, 20 nt, Artificial Sequence
  TRBC-51
aguccaguucuacgggcucu

SEQ ID NO: 1266 - RNA, 20 nt, Artificial Sequence
  TRBC-26
cgcugucaaguccaguucua

SEQ ID NO: 1267 - RNA, 20 nt, Artificial Sequence
  TRBC-47
aucgucagcgccgaggccug

SEQ ID NO: 1268 - RNA, 20 nt, Artificial Sequence
  TRBC-45
ucaaacacagcgaccucggg

SEQ ID NO: 1269 - RNA, 20 nt, Artificial Sequence
  TRBC-34
cguagaacuggacuugacag

SEQ ID NO: 1270 - RNA, 20 nt, Artificial Sequence
  TRBC-227
aggccucggcgcugacgauc

SEQ ID NO: 1271 - RNA, 20 nt, Artificial Sequence
  TRBC-41
ugacagcggaagugguugcg

SEQ ID NO: 1272 - RNA, 20 nt, Artificial Sequence
  TRBC-30
uugacagcggaagugguugc

SEQ ID NO: 1273 - RNA, 20 nt, Artificial Sequence
  TRBC-206
ucuccgagagcccguagaac

SEQ ID NO: 1274 - RNA, 20 nt, Artificial Sequence
  TRBC-32
cgggugggaacacguuuuuc

SEQ ID NO: 1275 - RNA, 20 nt, Artificial Sequence
  TRBC-276
gacagguuuggcccuauccu

SEQ ID NO: 1276 - RNA, 20 nt, Artificial Sequence
  TRBC-274
gaucgucagcgccgaggccu

SEQ ID NO: 1277 - RNA, 20 nt, Artificial Sequence
  TRBC-230
ggcucaaacacagcgaccuc

SEQ ID NO: 1278 - RNA, 20 nt, Artificial Sequence
  TRBC-235
ugagggucucggccaccuuc

SEQ ID NO: 1279 - RNA, 20 nt, Artificial Sequence
  TRBC-38
aggcuucuaccccgaccacg

SEQ ID NO: 1280 - RNA, 20 nt, Artificial Sequence
  TRBC-223
ccgaccacguggagcugagc

SEQ ID NO: 1281 - RNA, 20 nt, Artificial Sequence
  TRBC-221
ugacagguuuggcccuaucc

SEQ ID NO: 1282 - RNA, 20 nt, Artificial Sequence
  TRBC-48
cuugacagcggaagugguug

SEQ ID NO: 1283 - RNA, 20 nt, Artificial Sequence
  TRBC-216
agaucgucagcgccgaggcc

SEQ ID NO: 1284 - RNA, 20 nt, Artificial Sequence
  TRBC-210
gcgcugacgaucugggugac

SEQ ID NO: 1285 - RNA, 20 nt, Artificial Sequence
  TRBC-268
ugagggcgggcugcuccuug

SEQ ID NO: 1286 - RNA, 20 nt, Artificial Sequence
  TRBC-193
guugcggggguucugccaga

SEQ ID NO: 1287 - RNA, 20 nt, Artificial Sequence
  TRBC-246
agcucagcuccacguggucg

SEQ ID NO: 1288 - RNA, 20 nt, Artificial Sequence
  TRBC-228
gcggcugcucaggcaguauc

SEQ ID NO: 1289 - RNA, 20 nt, Artificial Sequence
  TRBC-43
gcggggguucugccagaagg

SEQ ID NO: 1290 - RNA, 20 nt, Artificial Sequence
  TRBC-272
uggcucaaacacagcgaccu

SEQ ID NO: 1291 - RNA, 20 nt, Artificial Sequence
  TRBC-33
acuggacuugacagcggaag

SEQ ID NO: 1292 - RNA, 20 nt, Artificial Sequence
  TRBC-44
gacagcggaagugguugcgg

SEQ ID NO: 1293 - RNA, 20 nt, Artificial Sequence
  TRBC-211
gcugucaaguccaguucuac

SEQ ID NO: 1294 - RNA, 20 nt, Artificial Sequence
  TRBC-253
guaucuggagucauugaggg

SEQ ID NO: 1295 - RNA, 17 nt, Artificial Sequence
  TRBC-18
cucggcgcugacgaucu

SEQ ID NO: 1296 - RNA, 17 nt, Artificial Sequence
  TRBC-6
ccucggcgcugacgauc

SEQ ID NO: 1297 - RNA, 17 nt, Artificial Sequence
  TRBC-85
ccgagagcccguagaac

SEQ ID NO: 1298 - RNA, 17 nt, Artificial Sequence
  TRBC-129
ccagaucgucagcgccg

SEQ ID NO: 1299 - RNA, 17 nt, Artificial Sequence
  TRBC-93
gaaugacgaguggaccc

SEQ ID NO: 1300 - RNA, 22 nt, Artificial Sequence
  TRBC-415
gggugacagguuuggcccuauc

SEQ ID NO: 1301 - RNA, 21 nt, Artificial Sequence
  TRBC-414
ggugacagguuuggcccuauc

SEQ ID NO: 1302 - RNA, 20 nt, Artificial Sequence
  TRBC-310
gugacagguuuggcccuauc

SEQ ID NO: 1303 - RNA, 18 nt, Artificial Sequence
  TRBC-308
gacagguuuggcccuauc

SEQ ID NO: 1304 - RNA, 22 nt, Artificial Sequence
  TRBC-401
gauacugccugagcagccgccu

SEQ ID NO: 1305 - RNA, 24 nt, Artificial Sequence
  TRBC-468
gaccacguggagcugagcuggugg

SEQ ID NO: 1306 - RNA, 18 nt, Artificial Sequence
  TRBC-462
guggagcugagcuggugg

SEQ ID NO: 1307 - RNA, 24 nt, Artificial Sequence
  TRBC-424
gggcgggcugcuccuugaggggcu

SEQ ID NO: 1308 - RNA, 23 nt, Artificial Sequence
  TRBC-423
ggcgggcugcuccuugaggggcu

SEQ ID NO: 1309 - RNA, 22 nt, Artificial Sequence
  TRBC-422
gcgggcugcuccuugaggggcu

SEQ ID NO: 1310 - RNA, 20 nt, Artificial Sequence
  TRBC-420
gggcugcuccuugaggggcu

SEQ ID NO: 1311 - RNA, 19 nt, Artificial Sequence
  TRBC-419
ggcugcuccuugaggggcu

SEQ ID NO: 1312 - RNA, 18 nt, Artificial Sequence
  TRBC-418
gcugcuccuugaggggcu

SEQ ID NO: 1313 - RNA, 24 nt, Artificial Sequence
  TRBC-445
ggugaaugggaaggaggugcacag

SEQ ID NO: 1314 - RNA, 23 nt, Artificial Sequence
  TRBC-444
gugaaugggaaggaggugcacag

SEQ ID NO: 1315 - RNA, 21 nt, Artificial Sequence
  TRBC-442
gaaugggaaggaggugcacag

SEQ ID NO: 1316 - RNA, 96 nt, Artificial Sequence
  exemplary gRNA
  misc_feature (1)...(20): n is a, c, u, g, unknown or other
nnnnnnnnnnnnnnnnnnnnguuuuagagcuagaaauagcaaguuaaaauaaggcuaguccguuaucaacuugaaaaaguggcaccgagucggugc

SEQ ID NO: 1317 - RNA, 104 nt, Artificial Sequence
  exemplary gRNA
  misc_feature (1)...(20): n is a, c, u, g, unknown or other
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 1318 - RNA, 106 nt, Artificial Sequence
  exemplary gRNA
  misc_feature (1)...(20): n is a, c, u, g, unknown or other
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 1319 - RNA, 116 nt, Artificial Sequence
  exemplary gRNA
  misc_feature (1)...(20): n is a, c, u, g, unknown or other
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 1320 - RNA, 96 nt, Artificial Sequence
  exemplary gRNA
  misc_feature (1)...(20): n is a, c, u, g, unknown or other
nnnnnnnnnnnnnnnnnnnnguauuagagcuagaaauagcaaguuaauauaaggcuaguccguuaucaacuugaaaaaguggcaccgagucggugc

SEQ ID NO: 1321 - RNA, 96 nt, Artificial Sequence
  exemplary gRNA
  misc_feature (1)...(20): n is a, c, u, g, unknown or other
nnnnnnnnnnnnnnnnnnnnguuuaagagcuagaaauagcaaguuuaaauaaggcuaguccguuaucaacuugaaaaaguggcaccgagucggugc

SEQ ID NO: 1322 - RNA, 116 nt, Artificial Sequence
  exemplary gRNA
  misc_feature (1)...(20): n is a, c, u, g, unknown or other
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 1323 - RNA, 47 nt, Artificial Sequence
  exemplary proximal and tail domains
aaggcuaguccguuaucaacuugaaaaaguggcaccgagucggugcu

SEQ ID NO: 1324 - RNA, 49 nt, Artificial Sequence
  exemplary proximal and tail domains
aaggcuaguccguuaucaacuugaaaaaguggcaccgagucgguggugc

SEQ ID NO: 1325 - RNA, 51 nt, Artificial Sequence
  exemplary proximal and tail domains
aaggcuaguccguuaucaacuugaaaaaguggcaccgagucggugcggauc

SEQ ID NO: 1326 - RNA, 31 nt, Artificial Sequence
  exemplary proximal and tail domains
aaggcuaguccguuaucaacuugaaaaagug

SEQ ID NO: 1327 - RNA, 18 nt, Artificial Sequence
  exemplary proximal and tail domains
aaggcuaguccguuauca

SEQ ID NO: 1328 - RNA, 12 nt, Artificial Sequence
  exemplary proximal and tail domains
aaggcuaguccg

SEQ ID NO: 1329 - RNA, 102 nt, Artificial Sequence
  exemplary gRNA
  misc_feature (1)...(20): n is a, c, u, g, unknown or other
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 1330 - RNA, 102 nt, Artificial Sequence
  exemplary gRNA
  misc_binding (1)...(20): n is a, c, u, g, unknown or other
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 1331 - protein, 1344 aa, Streptococcus mutans
KKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 1332 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1333 - protein, 1387 aa, Streptococcus thermophilus
TKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 1334 - protein, 1333 aa, Listeria innocua
KKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 1335 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 1336 - protein, 1368 aa, Streptococcus pyogenes [sequence omitted]

SEQ ID NO: 1337 - DNA, 4107 bp, Artificial Sequence
  S. pyogenes Cas9 codon optimized nucleic acid sequence
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 1338 - protein, 1368 aa, Streptococcus pyogenes [sequence omitted]

SEQ ID NO: 1339 - DNA, 3249 bp, Artificial Sequence
  N. meningitidis Cas9 codon optimized nucleic acid sequence
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 1340 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 1341 - DNA, 3159 bp, Artificial Sequence
  S. aureus Cas9
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 1342 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 1343 - DNA, 611 bp, Artificial Sequence
  TRAC 5' homology arm
ctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgat

SEQ ID NO: 1344 - DNA, 628 bp, Artificial Sequence
  TRAC 3' homology arm
tttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtg

SEQ ID NO: 1345 - DNA, 544 bp, Artificial Sequence
  Ef1alpha promoter with HTLV1 enhancer
ggatctgcgatcgctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctac

SEQ ID NO: 1346 - DNA, 66 bp, Artificial Sequence
  P2A nucleotide sequence
ggatctggagcgacgaattttagtctactgaaacaagcgggagacgtggaggaaaaccctggacct

SEQ ID NO: 1347 - DNA, 347 bp, Artificial Sequence
  MND promoter
gaacagagaaacaggagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatc

SEQ ID NO: 1348 - DNA, 20 bp, Artificial Sequence
  Target sequence
gagaatcaaaatcggtgaat

SEQ ID NO: 1349 - DNA, 20 bp, Artificial Sequence
  Target sequence
ggcctcggcgctgacgatct

SEQ ID NO: 1350 - DNA, 149 bp, Artificial Sequence
  exemplary gRNA
agcgctctcgtacagagttggcattataatacgactcactataggggagaatcaaaatcggtgaatgttttagagctagaaatagcaagttaaaataaggctagtccgttatcaacttgaaaaagtggcaccgagtcggtgcttttttt

SEQ ID NO: 1351 - RNA, 100 nt, Artificial Sequence
  exemplary gRNA
gagaaucaaaaucggugaauguuuuagagcuagaaauagcaaguuaaaauaaggcuaguccguuaucaacuugaaaaaguggcaccgagucggugcuuuu

SEQ ID NO: 1352 - protein, 142 aa, Homo sapiens; identical to SEQ ID NO: 220
  Human TCR alpha constant
  ref <308>: DATABASE ACCESSION NUMBER: Uniprot P01848
  ref <309>: DATABASE ENTRY DATE: 1986-07-21

SEQ ID NO: 1353 - protein, 177 aa, Homo sapiens; identical to SEQ ID NO: 214
  Human TCR beta constant 1
  ref <308>: DATABASE ACCESSION NUMBER: Uniprot P01850
  ref <309>: DATABASE ENTRY DATE: 1986-07-21

SEQ ID NO: 1354 - protein, 178 aa, Homo sapiens
  Human TCR beta constant 2
  ref <308>: DATABASE ACCESSION NUMBER: Uniprot A0A5B9
  ref <309>: DATABASE ENTRY DATE: 2010-04-20
DLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1355 - protein, 141 aa, Homo sapiens; identical to SEQ ID NO: 213
  Human TCRalpha. constant
  ref <308>: DATABASE ACCESSION NUMBER: Genbank CAA26636.1
  ref <309>: DATABASE ENTRY DATE: 2016-07-25

SEQ ID NO: 1356 - protein, 179 aa, Homo sapiens; identical to SEQ ID NO: 216
  Human TCR beta constant
  ref <308>: DATABASE ACCESSION NUMBER: Uniprot A0A0G2JNG9
  ref <309>: DATABASE ENTRY DATE: 2017-06-07

SEQ ID NO: 1357 - DNA, 25 bp, Artificial Sequence
  Exemplary splice acceptor site
ctgacctcttctcttcctcccacag

SEQ ID NO: 1358 - DNA, 13 bp, Artificial Sequence
  Exemplary splice acceptor site
tttctctccacag

SEQ ID NO: 1359 - DNA, 1189 bp, Artificial Sequence
  EF1alpha promoter
  ref <308>: DATABASE ACCESSION NUMBER: GenBank: J04617.1
  ref <309>: DATABASE ENTRY DATE: 1994-11-07
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaa

SEQ ID NO: 1360 - DNA, 1205 bp, Artificial Sequence
  EF1alpha promoter
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcactagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgtggccttgcgcttaaggagccccttcgcctcgtgcttgagttgtggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatcagcacactggtatttcggtttttggggccgcgggcggcgacggggcccgtgcgtcccagcgcacatgttcggcgaggcggggcctgcgagcgcggccaccgagaatcggacgggggtagtctcaagctgcccggcctgctctggtgcctggcctcgcgccgccgtgtatcgccccgccctgggcggcaaggctggcccggtcggcaccagttgcgtgagcggaaagatggccgcttcccggccctgctgcagggagcacaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctccagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaa

SEQ ID NO: 1361 - DNA, 181 bp, Artificial Sequence
  MND promoter
gggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 1362 - protein, 137 aa, Artificial Sequence; identical to SEQ ID NO: 833
  Alpha Mouse constant region

SEQ ID NO: 1363 - protein, 177 aa, Artificial Sequence; identical to SEQ ID NO: 197
  Beta human constant region

SEQ ID NO: 1364 - DNA, 138 bp, Artificial Sequence
  Partial recombinant TCRalpha constant region exon 1 sequence
cagaacccagatcccgcggtatatcaactgcgcgactcaaaatcatccgataagagtgtctgtttgtttactgacttcgacagtcaaactaatgtctctcagagcaaagattccgatgtctacatcactgacaagtgc

SEQ ID NO: 1365 - protein, 18 aa, Artificial Sequence
  TCR alpha overall CDR3 consensus
  VARIANT (1)...(1): X=A, I, or V
  VARIANT (2)...(2): X = M, L, V, E, or A
  VARIANT (3)...(3): X= R, L, N, or S
  VARIANT (4)...(4): X = E, V, P, T, F, I, R, or A
  VARIANT (5)...(5): X = G, I, L, A, P, R, D, or H
  VARIANT (6)...(6): X= R, T, G, S, N, or H
  VARIANT (7)...(7): X= G, R, A, N, or null
  VARIANT (8)...(8): X= T, G, or null
  VARIANT (9)...(9): X= null or A or G
  VARIANT (10)...(10): X= null or G
  VARIANT (11)...(11): X= null or G
  VARIANT (12)...(12): X= null or T;
  VARIANT (13)...(13): X = F, Y, A, S or null;
  VARIANT (14)...(14): X = G, Y, or N;
  VARIANT (15)...(15): X = F, G, T, N, Q, or Y;
  VARIANT (16)...(16): X = K, P, V, N or A;
  VARIANT (17)...(87): X17= T, L, or F; X18= I, V, T, H, or N
XXXXXXXXXXXXXXXXXX

SEQ ID NO: 1366 - protein, 15 aa, Artificial Sequence
  TCR beta overall CDR3 consensus
  VARIANT (1)...(1): X = A or S
  VARIANT (2)...(2): X = S, I, or V
  VARIANT (3)...(3): X = S, T, or V;
  VARIANT (4)...(4): X = H, P, L, Y, T, D, or Q
  VARIANT (5)...(5): X = L, G, W, F, S, or R
  VARIANT (6)...(6): X = A, G, L, S, or T
  VARIANT (7)...(7): X = G, E, A, T, R, or null
  VARIANT (8)...(8): X = null or G
  VARIANT (9)...(9): X = null or G
  VARIANT (10)...(10): X= null, F, G, T, S, or A
  VARIANT (11)...(11): X= T, N, H, A, S, or F
  VARIANT (12)...(12): X = G, T, Q, D, Y, or L
  VARIANT (13)...(13): X = E, P, T, G or W
  VARIANT (14)...(14): X = L, A, Q, Y or K
  VARIANT (15)...(15): X= F, H, Y, or T
XXXXXXXXXXXXXXX

SEQ ID NO: 1367 - protein, 7 aa, Artificial Sequence
  TCR alpha overall CDR1 consensus
  VARIANT (1)...(1): X = T, D, N, or V
  VARIANT (2)...(2): X = I or S
  VARIANT (3)...(3): X = S, D, A, P, or M
  VARIANT (4)...(4): X = G, Q, P, or null
  VARIANT (5)...(5): X = T, S, I, or F
  VARIANT (6)...(6): X = D, Y,Q, T, or S
  VARIANT (7)...(7): X = Y, G, N, or Q
XXXXXXX

SEQ ID NO: 1368 - protein, 7 aa, Artificial Sequence
  TCR beta overall CDR2 consensus
  VARIANT (1)...(1): X = F, Y, S, or A
  VARIANT (2)...(2): X= Q, Y, V, or N
  VARIANT (3)...(3): X = N, D, G, F or Q
  VARIANT (4)...(4): X= null or G
  VARIANT (5)...(5): X = E, V, N, K or S
  VARIANT (6)...(6): X = A, K, G, or E
  VARIANT (7)...(7): X = Q, M, T, I, or A
XXXXXXX

SEQ ID NO: 1369 - protein, 5 aa, Artificial Sequence
  TCR beta overall CDR1 consensus
  VARIANT (1)...(1): X = S, M or L
  VARIANT (2)...(2): X= G, E, D, N, or Q
  VARIANT (3)...(3): X = H or V
  VARIANT (4)...(4): X = V, N, E, L, or T
  VARIANT (5)...(5): X = S, R, N, Y, A or M
XXXXX

SEQ ID NO: 1370 - protein, 18 aa, Artificial Sequence
  TCR alpha E6(29-38) CDR3 consensus
  VARIANT (1)...(1): X1 = A, I, or V
  VARIANT (2)...(2): X2 = M, L, or V
  VARIANT (3)...(3): X3 = R, L, or N
  VARIANT (4)...(4): X4 = E, V, T, P, or F
  VARIANT (5)...(5): X5 = G, I, L, A, or P
  VARIANT (6)...(6): X6 = R, T, G, or S
  VARIANT (7)...(7): X7 = G, R, or null
  VARIANT (8)...(8): X8 = T, G, or null
  VARIANT (9)...(9): X9 = null or A
  VARIANT (10)...(10): X10 = null or G
  VARIANT (11)...(11): X11 = null or G
  VARIANT (12)...(12): X12 = null or T
  VARIANT (13)...(13): X13 = null or S
  VARIANT (14)...(14): X14 = G, Y, or N
  VARIANT (15)...(15): X15 = F, G, or T
  VARIANT (16)...(16): X16 = K or P
  VARIANT (17)...(18): X17 = T or L; X18 = I, V, or T
XXXXXXXXXXXXXXXXXX

SEQ ID NO: 1371 - protein, 7 aa, Artificial Sequence
  TCR alpha E6(29-38) CDR1 consensus
  VARIANT (1)...(1): X1 = T, D, or N
  VARIANT (2)...(2): X2 = I, or S
  VARIANT (3)...(3): X3 = S, D, or A
  VARIANT (4)...(4): X4 = G, Q, P, or null
  VARIANT (5)...(5): X5 = T, S, or I
  VARIANT (6)...(6): X6 = D, Y, or Q
  VARIANT (7)...(7): X7 = Y, G, N, or Q
XXXXXXX

SEQ ID NO: 1372 - protein, 8 aa, Artificial Sequence
  TCR alpha E6(29-38) CDR2 consensus
  VARIANT (1)...(1): X1 = G, Q, I, or V
  VARIANT (2)...(2): X2 = L, S, Q, or Y
  VARIANT (3)...(3): X3 = T, G, or S
  VARIANT (4)...(4): X4 = Y, S, or null
  VARIANT (5)...(5): X5 = null or D
  VARIANT (6)...(6): X6 = null, E, Q, or S
  VARIANT (7)...(7): X7 = S, Q, R, or G
  VARIANT (8)...(8): X8 = N, or E
XXXXXXXX

SEQ ID NO: 1373 - protein, 13 aa, Artificial Sequence
  TCR beta E6(29-38) CDR3 consensus
  VARIANT (4)...(4): X4 = H, P, L, or Y
  VARIANT (5)...(5): X5 = L, G, W, F, or S
  VARIANT (6)...(6): X6 = A, G, or L
  VARIANT (7)...(7): X7 = G, E, A, T, or null
  VARIANT (8)...(8): X8 = F, G, T, or S
  VARIANT (9)...(9): X9 = T, N, H, or A
  VARIANT (10)...(10): X10 = G, T, Q, D, or Y
  VARIANT (11)...(11): X11 = E, P, T, or G
  VARIANT (12)...(12): X12 = L, A, Q, or Y
  VARIANT (13)...(13): X13 = F, H, Y, or T
ASSXXXXXXXXXX

SEQ ID NO: 1374 - protein, 11 aa, Artificial Sequence
  TCR alpha E7(11-19) CDR3 consensus
  VARIANT (1)...(1): X1 = A or V
  VARIANT (2)...(2): X2 = E or V
  VARIANT (4)...(4): X4 = I, or R
  VARIANT (5)...(5): X5 = R, or D
  VARIANT (6)...(6): X6 = G, or N
  VARIANT (7)...(7): X7 = F, or Y
  VARIANT (8)...(8): X8 = N or Q
  VARIANT (9)...(9): X9 = V or N
  VARIANT (10)...(10): X10 = L or F
  VARIANT (11)...(11): X11 = H or V
XXSXXXXXXXX

SEQ ID NO: 1375 - DNA, 876 bp, Homo sapiens
  TCR 66 Codon-optimized/ cysteine-modified beta
gagcccgaagtgacccagacacccagccaccaggtcacacagatgggccaggaagtgatcctgcgctgcgtgcccatcagcaaccacctgtacttctactggtacagacagatcctgggccagaaggtggaattcctcgtcagcttctacaacaacgagatcagcgagaagtccgagattttcgacgaccagttcagcgtggaacggcccgacggcagcaacttcaccctgaagatcagaagcaccaagctcgaggacagcgccatgtacttttgcgccaccaccggcagaagcagctacgagcagtacttcggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcagggga

SEQ ID NO: 1376 - protein, 292 aa, Homo sapiens
  TCR 66 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCATTGRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1377 - protein, 292 aa, Homo sapiens
  TCR 66 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCATTGRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1378 - protein, 311 aa, Homo sapiens
  TCR 66 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCATTGRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1379 - protein, 311 aa, Homo sapiens
  TCR 66 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCATTGRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1380 - protein, 113 aa, Homo sapiens
  TCR 66 - beta variable
EPEVTQTPSHQVTQMGQEVILRCVPISNHLYFYWYRQILGQKVEFLVSFYNNEISEKSEIFDDQFSVERPDGSNFTLKIRSTKLEDSAMYFCATTGRSSYEQYFGPGTRLTVT

SEQ ID NO: 1381 - protein, 11 aa, Homo sapiens
  TCR 66 Beta CDR3
ATTGRSSYEQY

SEQ ID NO: 1382 - DNA, 1833 bp, Homo sapiens
  TCR 66 Codon-optimized/ cysteine-modified full sequence
atggatacctggctcgtgtgctgggccatcttcagcctgctgaaggccggactgaccgagcccgaagtgacccagacacccagccaccaggtcacacagatgggccaggaagtgatcctgcgctgcgtgcccatcagcaaccacctgtacttctactggtacagacagatcctgggccagaaggtggaattcctcgtcagcttctacaacaacgagatcagcgagaagtccgagattttcgacgaccagttcagcgtggaacggcccgacggcagcaacttcaccctgaagatcagaagcaccaagctcgaggacagcgccatgtacttttgcgccaccaccggcagaagcagctacgagcagtacttcggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgatgatcagcctgcgggtgctgctggtcatcctgtggctgcagctgagctgggtctggtcccagcggaaagaggtggaacaggaccctggccccttcaacgtgccagagggcgctaccgtggccttcaactgcacctacagcaacagcgccagccagagcttcttctggtacagacaggactgccggaaagaacccaagctgctgatgagcgtgtacagcagcggcaacgaggacggcagattcaccgcccagctgaaccgggccagccagtacatctccctgctgatccgggacagcaagctgagcgacagcgccacctacctgtgcgtggtcaacagcagacctagaagcagcggcggcagctacatccccacctttggcagaggcaccagcctgatcgtgcacccctatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcc

SEQ ID NO: 1383 - protein, 611 aa, Homo sapiens
  TCR 66 Full Sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCATTGRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNSRPRSSGGSYIPTFGRGTSLIVHPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 1384 - protein, 611 aa, Homo sapiens
  TCR 66 Full Sequence Cysteine modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCATTGRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNSRPRSSGGSYIPTFGRGTSLIVHPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 1385 - DNA, 768 bp, Homo sapiens
  TCR 66 Codon-optimized/ cysteine-modified alpha
cggaaagaggtggaacaggaccctggccccttcaacgtgccagagggcgctaccgtggccttcaactgcacctacagcaacagcgccagccagagcttcttctggtacagacaggactgccggaaagaacccaagctgctgatgagcgtgtacagcagcggcaacgaggacggcagattcaccgcccagctgaaccgggccagccagtacatctccctgctgatccgggacagcaagctgagcgacagcgccacctacctgtgcgtggtcaacagcagacctagaagcagcggcggcagctacatccccacctttggcagaggcaccagcctgatcgtgcacccctatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcc

SEQ ID NO: 1386 - protein, 256 aa, Homo sapiens
  TCR 66 - Alpha Native
RKEVEQDPGPFNVPEGATVAFNCTYSNSASQSFFWYRQDCRKEPKLLMSVYSSGNEDGRFTAQLNRASQYISLLIRDSKLSDSATYLCVVNSRPRSSGGSYIPTFGRGTSLIVHPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 1387 - protein, 256 aa, Homo sapiens
  TCR 66 - Alpha Cysteine-modified
RKEVEQDPGPFNVPEGATVAFNCTYSNSASQSFFWYRQDCRKEPKLLMSVYSSGNEDGRFTAQLNRASQYISLLIRDSKLSDSATYLCVVNSRPRSSGGSYIPTFGRGTSLIVHPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 1388 - protein, 278 aa, Homo sapiens
  TCR 66 - Alpha Native
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNSRPRSSGGSYIPTFGRGTSLIVHPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 1389 - protein, 278 aa, Homo sapiens
  TCR 66 - Alpha Cysteine-modified
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNSRPRSSGGSYIPTFGRGTSLIVHPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 1390 - protein, 115 aa, Homo sapiens
  TCR 66-  alpha variable
RKEVEQDPGPFNVPEGATVAFNCTYSNSASQSFFWYRQDCRKEPKLLMSVYSSGNEDGRFTAQLNRASQYISLLIRDSKLSDSATYLCVVNSRPRSSGGSYIPTFGRGTSLIVHP

SEQ ID NO: 1391 - protein, 16 aa, Homo sapiens
  TCR 66 - alpha CDR3
VVNSRPRSSGGSYIPT

What is claimed:

1. A polynucleotide, comprising:
   (a) a nucleic acid sequence encoding a T cell receptor (TCR) or an antigen-binding portion thereof that binds to or recognizes a peptide epitope of human papillomavirus (HPV) 16 in the context of an MHC molecule, and
   (b) two or more homology arm(s) linked to the nucleic acid sequence, wherein: the two or more homology arms comprise a sequence homologous to one or more region(s) of an open reading frame of a T cell receptor alpha constant (TRAC) locus;
   wherein the two or more homology arm(s) comprises a 5' homology arm and a 3' homology arm,
   wherein the 5' homology arm comprises the sequence set forth in SEQ ID NO: 1343, and
   wherein the 3' homology arm comprises a sequence comprising at least 150 contiguous nucleotides of the sequence set forth in SEQ ID NO: 1344.

2. The polynucleotide of claim 1, wherein the nucleic acid sequence of (a) comprises one or more multicistronic element(s), wherein the one or more multicistronic element(s) are:
   positioned between a nucleic acid sequence encoding the TCRα or a portion thereof and a nucleic acid sequence encoding the TCRβ or a portion thereof; or
   are upstream of a nucleic acid sequence encoding the TCRα or a portion thereof or upstream of a nucleic acid sequence encoding the TCRβ or a portion thereof.

3. The polynucleotide of claim 2, wherein the one or more multicistronic element is or comprises a ribosome skip sequence selected from the group consisting of: a T2A, a P2A, an E2A, and an F2A element.

4. The polynucleotide of claim 1, wherein the nucleic acid sequence of (a) comprises one or more heterologous or regulatory control element(s) operably linked to control expression of the TCR when expressed from a cell introduced with the polynucleotide.

5. The polynucleotide of claim 4, wherein the one or more heterologous regulatory or control element(s) comprise a heterologous promoter.

6. A vector comprising the polynucleotide of claim 1.

7. The vector of claim 6, wherein the vector is a viral vector.

8. An in vitro engineered cell comprising the polynucleotide of claim 1.

9. An in vitro engineered cell comprising the vector of claim 6.

10. The engineered cell of claim 8, comprising a genetic disruption of an endogenous T cell receptor alpha constant (TRAC) gene and/or a T cell receptor beta constant (TRBC) gene.

11. The engineered cell of claim 10, wherein the genetic disruption comprises a mutation or deletion in a region of a TRAC or a TRBC gene that is within a coding region, wherein the coding region a) is an early coding region of the gene, b) is within exon 1 of the gene, c) is in the coding region within 500, 400, 300, 200, 100, or 50 base pairs of a start codon of the gene, or d) is within a target site sequence that is complementary to a targeting site of a guide RNA (gRNA) targeting domain having a sequence selected from any of SEQ ID NOS:1053 and 1259-1315, and/or wherein a targeting domain having a sequence selected from among SEQ ID NOS:1053 and 1259-1315 specifically hybridizes to the coding region, and/or wherein the coding region is within a target site sequence that is complementary to a targeting site of a gRNA targeting domain having a sequence selected from any of SEQ ID NOS: 1048 and 1229-1258, and/or wherein a targeting domain having a sequence selected from among SEQ ID NOS: 1048 and 1229-1258 specifically hybridizes to the coding region.

12. The engineered cell of claim 10, wherein the endogenous TRAC locus is further modified by:
   integration of a nucleic acid sequence encoding the TCR or an antigen-binding fragment thereof at the TRAC locus; or
   integration of a transgene sequence encoding a portion of the TCR or an antigen-binding fragment thereof.

13. The engineered cell of claim 8, wherein the engineered cell is a T cell.

14. The engineered cell of claim 13, wherein the T cell is CD8+ or is a CD4+ cell.

15. A method for producing a cell, comprising introducing into the cell the vector of claim 6.

16. A method for producing a cell, comprising introducing into the cell the polynucleotide of claim 1.

17. The method of claim 15, further comprising introducing into the cell one or more agent, wherein each of the one or more agent is independently capable of inducing a genetic disruption of a T cell receptor alpha constant (TRAC) gene and/or a T cell receptor beta constant (TRBC) gene.

18. The method of claim 17, wherein the one or more agent capable of inducing a genetic disruption comprises:
   a clustered regularly interspaced short palindromic nucleic acid (CRISPR)-associated nuclease (Cas) specific for a target site within the TRAC and/or TRBC gene; and/or
   a guide RNA (gRNA) having a targeting domain that is complementary to the at least one target site.

19. The method of claim 17, wherein the one or more agent is introduced as:
   a ribonucleoprotein (RNP) complex comprising the gRNA and a Cas9 protein; or
   one or more polynucleotide encoding the gRNA and/or a Cas9 protein.

20. A composition comprising the engineered cell of claim 8.

21. A method of treatment comprising administering the engineered cell of claim 13 to a subject having a disease or disorder associated with HPV.

22. A method of treatment comprising administering the engineered cell of claim 9 to a subject having a disease or disorder associated with HPV, wherein the engineered cell is a T cell.

23. The polynucleotide of claim 1, wherein the 3' homology arm comprises a sequence comprising at least 600 contiguous nucleotides of the sequence set forth in SEQ ID NO: 1344.

24. The polynucleotide of claim 1, wherein the 3' homology arm comprises the sequence set forth in SEQ ID NO: 1344.

25. The polynucleotide of claim 1, wherein the peptide epitope is or comprises E7(11-19) YMLDLQPET (SEQ ID NO:236).

26. The polynucleotide of claim 1, wherein the peptide epitope is or comprises E6(29-38) TIHDIILECV (SEQ ID NO:233).

27. The polynucleotide of claim 1, wherein the nucleic acid sequence encoding the TCR or an antigen-binding portion thereof encodes (i) a T cell receptor beta (TCRβ) chain comprising a variable beta (Vβ) of the TCR or antigen-binding fragment thereof and a constant beta (Cβ); and (ii) a T cell receptor alpha (TCRα) chain comprising a variable alpha (Vα) of the TCR or antigen-binding fragment thereof, wherein the TCRα chain comprises a full-length TCRα chain.

28. The polynucleotide of claim 1, wherein the nucleic acid sequence encoding the TCR or an antigen-binding portion thereof encodes (i) a T cell receptor beta (TCRβ) chain comprising a variable beta (Vβ) of the TCR or antigen-binding fragment thereof and a constant beta (Cβ); and (ii) a portion of a T cell receptor alpha (TCRα) chain comprising a variable alpha (Vα) of the TCR or antigen-binding fragment thereof, wherein the portion of the TCRα chain is less than a full-length TCRα chain.

29. The polynucleotide of claim 28, wherein the TCRα chain comprises a constant alpha (Cα), wherein at least a portion of said Cα is encoded by the open reading frame of the endogenous TRAC locus or a partial sequence thereof when the TCR or antigen-binding fragment thereof is expressed from a cell introduced with the polynucleotide.

30. The polynucleotide of claim 29, wherein the nucleic acid sequence of (a) and one of the two or more homology arms together comprise a sequence of nucleotides encoding the Cα that is less than the full length of a native Cα, wherein at least a portion of the Cα is encoded by the open reading frame of the endogenous TRAC locus or a partial sequence thereof when the TCR or antigen-binding fragment thereof is expressed from a cell introduced with the polynucleotide.

31. The polynucleotide of claim 27, wherein the nucleic acid sequence encoding the TCRβ chain is upstream of the nucleic acid sequence encoding the TCRα chain or the portion of the TCRα chain.

32. The polynucleotide of claim 27, wherein the nucleic acid sequence encoding the TCR or an antigen-binding portion thereof does not comprise an intron.

33. The polynucleotide of claim 27, wherein the nucleic acid sequence encoding the TCR or an antigen-binding portion thereof is a sequence that is exogenous or heterologous to an open reading frame of an endogenous genomic TRAC locus of a T cell.

34. The polynucleotide of claim 27, wherein the nucleic acid sequence encoding the TCR or an antigen-binding portion thereof is in-frame with one or more exons or a partial sequence thereof.

35. The polynucleotide of claim 28, wherein a portion of the Cα is encoded by the open reading frame of the endogenous TRAC locus or a partial sequence thereof, and a further portion of the Cα is encoded by the nucleic acid sequence encoding the TCR or an antigen-binding portion thereof, wherein said further portion of Cα is less than the full length of a native Cα.

36. The polynucleotide of claim 35, wherein the further portion of the Cα is encoded by a sequence of nucleotides starting from residue 3 and up to residue 3155 of the sequence set forth in SEQ ID NO:348 or one or more exons thereof or a sequence that exhibits at least 85% or more sequence identity to a sequence of nucleotides starting from residue 3 and up to residue 3155 of the sequence set forth in SEQ ID NO:348 or one or more exons thereof, or a partial sequence thereof.

37. The polynucleotide of claim 35, wherein the further portion of the Cα is encoded by a sequence set forth in SEQ ID NO:1364, or a sequence that exhibits at least 85% or more sequence identity to SEQ ID NO:1364, or a partial sequence thereof.

38. The polynucleotide of claim 35, wherein the further portion of the Cα and/or the Cβ region encoded by the nucleic acid sequence of (a) comprises one or more modifications.

39. The polynucleotide of claim 38, wherein the one or more modifications comprises a replacement, deletion, or insertion of one or more amino acids compared to a native Cα region and/or a native Cβ region.

40. The polynucleotide of claim 39, wherein the one or more modifications introduces one or more cysteine residues that are capable of forming one or more non-native disulfide bridges between the alpha chain and beta chain.

41. The polynucleotide of claim 4, wherein the one or more heterologous regulatory or control elements comprise a human elongation factor 1 alpha (EF1α) promoter or an MND promoter.

42. The vector of claim 7, wherein the viral vector is a retroviral vector.

43. The vector of claim 7, wherein the viral vector is a lentiviral vector.

44. The vector of claim 7, wherein the viral vector is a gammaretroviral vector.

45. The vector of claim 7, wherein the viral vector is an AAV vector.

46. The vector of claim 45, wherein the AAV vector is selected from the group consisting of AAV1, AAV2, AAV3, AAV4, AAV5, AAV6, AAV7 and AAV8 vector.

* * * * *